United States Patent
Tresch et al.

(10) Patent No.: US 12,018,267 B2
(45) Date of Patent: Jun. 25, 2024

(54) PLANTS HAVING INCREASED TOLERANCE TO HERBICIDES

(71) Applicant: BASF SE, Ludwigshafen (DE)

(72) Inventors: Stefan Tresch, Ludwigshafen (DE); Mihiret Tekeste Sisay, Ludwigshafen (DE); Doreen Schachtschabel, Ludwigshafen (DE); Kristin Hanzlik, Limburgerhof (DE); Brigitte Weston, Limburgerhof (DE); Florian Vogt, Ludwigshafen (DE); Danny Geerdink, Ludwigshafen (DE); Jens Lerchl, Limburgerhof (DE)

(73) Assignee: BASF SE, Ludwigshafen (DE)

( * ) Notice: Subject to any disclaimer, the term of this patent is extended or adjusted under 35 U.S.C. 154(b) by 241 days.

(21) Appl. No.: 17/381,921

(22) Filed: Jul. 21, 2021

(65) Prior Publication Data

US 2022/0025392 A1    Jan. 27, 2022

Related U.S. Application Data

(63) Continuation of application No. 15/769,973, filed as application No. PCT/IB2016/056349 on Oct. 21, 2016, now abandoned.

(30) Foreign Application Priority Data

Oct. 22, 2015  (EP) ..................... 15190978

(51) Int. Cl.
    C12N 15/82   (2006.01)
    C12N 9/10    (2006.01)

(52) U.S. Cl.
    CPC ....... C12N 15/8274 (2013.01); C12N 9/1059 (2013.01)

(58) Field of Classification Search
    None
    See application file for complete search history.

(56) References Cited

U.S. PATENT DOCUMENTS

| | | | |
|---|---|---|---|
| 4,873,192 A | 10/1989 | Kunkel | |
| 4,945,050 A | 7/1990 | Sanford et al. | |
| 5,169,770 A | 12/1992 | Chee et al. | |
| 5,240,855 A | 8/1993 | Tomes | |
| 5,268,463 A | 12/1993 | Jefferson | |
| 5,316,931 A | 5/1994 | Donson et al. | |
| 5,322,783 A | 6/1994 | Tomes et al. | |
| 5,324,646 A | 6/1994 | Buising et al. | |
| 5,366,892 A | 11/1994 | Foncerrada et al. | |
| 5,376,543 A | 12/1994 | Chee et al. | |
| 5,380,831 A | 1/1995 | Adang et al. | |
| 5,399,680 A | 3/1995 | Zhu et al. | |
| 5,405,765 A | 4/1995 | Vasil et al. | |
| 5,424,412 A | 6/1995 | Brown et al. | |
| 5,436,391 A | 7/1995 | Fujimoto et al. | |
| 5,466,785 A | 11/1995 | de Framond | |
| 5,563,055 A | 10/1996 | Townsend et al. | |
| 5,565,350 A | 10/1996 | Kmiec | |
| 5,569,597 A | 10/1996 | Grimsley et al. | |
| 5,589,367 A | 12/1996 | Donson et al. | |
| 5,593,874 A | 1/1997 | Brown et al. | |
| 5,593,881 A | 1/1997 | Thompson et al. | |
| 5,604,121 A | 2/1997 | Hilder et al. | |
| 5,608,142 A | 3/1997 | Barton et al. | |
| 5,608,144 A | 3/1997 | Baden et al. | |
| 5,608,149 A | 3/1997 | Barry et al. | |
| 5,659,026 A | 8/1997 | Baszczynski et al. | |
| 5,723,756 A | 3/1998 | Peferoen et al. | |
| 5,736,369 A | 4/1998 | Bowen et al. | |
| 5,737,514 A | 4/1998 | Stiffler | |
| 5,747,450 A | 5/1998 | Ohba et al. | |
| 5,773,702 A | 6/1998 | Penner et al. | |
| 5,859,348 A | 1/1999 | Penner et al. | |
| 5,866,785 A | 2/1999 | Donson et al. | |
| 5,879,918 A | 3/1999 | Tomes et al. | |
| 5,886,244 A | 3/1999 | Tomes et al. | |
| 5,889,190 A | 3/1999 | Donson et al. | |
| 5,889,191 A | 3/1999 | Turpen | |
| 5,932,782 A | 8/1999 | Bidney | |
| 5,981,840 A | 11/1999 | Zhao et al. | |
| 5,990,387 A | 11/1999 | Tomes et al. | |
| 6,027,945 A | 2/2000 | Smith et al. | |
| 6,072,050 A | 6/2000 | Bowen et al. | |
| 6,177,611 B1 | 1/2001 | Rice | |
| 6,368,800 B1 | 4/2002 | Smith et al. | |

(Continued)

FOREIGN PATENT DOCUMENTS

| | | | |
|---|---|---|---|
| CN | 102112629 A | 6/2011 | |
| CN | 103930548 A | 7/2014 | |
| EP | 0242236 A1 | 10/1987 | |

(Continued)

OTHER PUBLICATIONS

"Method of the Year 2011", Nat. Methods, 9(1):1 (Jan. 2012).
Aldemita et al., "Agrobacterium tumefaciens-mediated transformation of japonica and indica rice varieties", Planta, vol. 199, Issue 4, Aug. 1996, pp. 612-617.
Allison et al., "The nucleotide sequence of the coding region of tobacco etch virus genomic RNA: Evidence for the synthesis of a single polyprotein", Virology, vol. 154, Issue 1, Oct. 15, 1986, pp. 9-20.
Altschul et al., "Basic local alignment search tool", Journal of Molecular Biology, vol. 215, Issue 3, Oct. 1990, pp. 403-410.
An et al., "Transformation of Tobacco, Tomato, Potato, and *Arabidopsis thaliana* Using a Binary Ti Vector System", Plant Physiology, vol. 81, 1986, pp. 301-305.

(Continued)

*Primary Examiner* — Medina A Ibrahim
(74) *Attorney, Agent, or Firm* — MARSHALL, GERSTEIN & BORUN LLP

(57) ABSTRACT

The present invention refers to a plant or plant part comprising a polynucleotide encoding a wildtype or mutated cellulose synthase (CESA) polypeptide, the expression of said polynucleotide confers to the plant or plant part tolerance to CESA-inhibiting herbicides, such as azines.

13 Claims, 15 Drawing Sheets

Specification includes a Sequence Listing.

(56) References Cited

U.S. PATENT DOCUMENTS

| | | | |
|---|---|---|---|
| 6,495,740 B1 * | 12/2002 | Arioli | C12N 9/1059 800/290 |
| 6,653,529 B2 | 11/2003 | Peng et al. | |

FOREIGN PATENT DOCUMENTS

| | | |
|---|---|---|
| EP | 0293356 A1 | 11/1988 |
| EP | 0337899 A1 | 10/1989 |
| EP | 0374753 A2 | 6/1990 |
| EP | 0427529 A1 | 5/1991 |
| EP | 0451878 A1 | 10/1991 |
| EP | 0397687 B1 | 5/1994 |
| EP | 0424047 B1 | 7/1995 |
| EP | 1198985 A1 | 4/2002 |
| EP | 2930174 A1 | 10/2015 |
| WO | WO-93/07256 A1 | 4/1993 |
| WO | WO-93/07278 A1 | 4/1993 |
| WO | WO-93/22443 A1 | 11/1993 |
| WO | WO-95/34656 A1 | 12/1995 |
| WO | WO-99/43838 A1 | 9/1999 |
| WO | WO-00/15815 A1 | 3/2000 |
| WO | WO-00/28058 A2 | 5/2000 |
| WO | WO-02/068607 A2 | 9/2002 |
| WO | WO-03/018810 A2 | 3/2003 |
| WO | WO-03/052073 A2 | 6/2003 |
| WO | WO-2005/054439 A2 | 6/2005 |
| WO | WO-2005/107437 A2 | 11/2005 |
| WO | WO-2006/024820 A1 | 3/2006 |
| WO | WO-2006/037945 A1 | 4/2006 |
| WO | WO-2006/136596 A2 | 12/2006 |
| WO | WO-2007/071900 A1 | 6/2007 |
| WO | WO-2007/096576 A1 | 8/2007 |
| WO | WO-2008/124495 A2 | 10/2008 |
| WO | WO-2008/141154 A2 | 11/2008 |
| WO | WO-2010/049269 A1 | 5/2010 |
| WO | WO-2010/049270 A1 | 5/2010 |
| WO | WO-2013/142968 A1 | 10/2013 |
| WO | WO-2014/064094 A1 | 5/2014 |
| WO | WO-2015/007711 A1 | 1/2015 |
| WO | WO-2015/144881 A1 | 10/2015 |
| WO | WO-2015/150541 A1 | 10/2015 |
| WO | WO-2015/155129 A1 | 10/2015 |
| WO | WO-2015/155271 A1 | 10/2015 |
| WO | WO-2015/155272 A1 | 10/2015 |
| WO | WO-2015/155273 A1 | 10/2015 |
| WO | WO-2015/162143 A1 | 10/2015 |
| WO | WO-2015/162166 A1 | 10/2015 |
| WO | WO-2015/162169 A1 | 10/2015 |
| WO | WO-2017/068543 A1 | 4/2017 |
| WO | WO-2017/068544 A1 | 4/2017 |

OTHER PUBLICATIONS

Archer et al., "Current views on chloroplast protein import and hypotheses on the origin of the transport mechanism", Journal of Bioenergetics and Biomembranes, vol. 22, Issue 6, Dec. 1990, pp. 789-810.
Arias et al., "Molecular evolution of herbicide resistance to phytoene desaturase inhibitors in Hydrilla verticillata and its potential use to generate herbicide-resistant crops", Pest Management Science, vol. 61, Issue 3, Mar. 2005, pp. 258-268.
Asano, et al., "Transgenic plants of Agrostis alba obtained by electroporation-mediated direct gene transfer into protoplasts", Plant Cell Reports, Feb. 1994, vol. 13, Issue 5, pp. 243-246.
Austin et al., "Next-generation mapping of *Arabidopsis* genes", The Plant Journal, vol. 67, Issue 4, Aug. 2011, pp. 715-725.
Ayres et al., "Genetic Transformation of Rice", Critical Reviews in Plant Sciences, vol. 13, Issue 3, 1994, pp. 219-239.
Baim et al., "A chimeric mammalian transactivator based on the lac repressor that is regulated by temperature and isopropyl beta-D-thiogalactopyranoside", Proceedings of the National Academy of Sciences, vol. 88, Issue 12, pp. 5072-5076 (1991).
Ballas et al., "Efficient functioning of plant promoters and poly(A) sites in Xenopus oocytes", Nucleic Acids Research, vol. 17, Issue 19, Oct. 11, 1989, pp. 7891-7903.
Barcelo, et al., "Transgenic cereal (tritordeum) plants obtained at high efficiency by microprojectile bombardment of inflorescence tissue", The Plant Journal, vol. 5, Issue 4, Apr. 1994, pp. 583-592.
Barkley, "Repressor Recognition of Operator and Effectors", The Operon, 1980, pp. 177-220.
Bateman et al., "The Pfam Protein Families Database", Nucleic Acids Research, vol. 30, Issue 1, 2002, pp. 276-280.
Becker et al., "Fertile transgenic wheat from microprojectile bombardment of scutellar tissue", The Plant Journal, vol. 5, Issue 2, Feb. 1994, pp. 299-307.
Behrens et al., "Dicamba Resistance: Enlarging and Preserving Biotechnology-Based Weed Management Strategies", Science, May 2007, vol. 316, Issue 5828, pp. 1185-1188.
Bevan, "Binary Agrobacterium vectors for plant transformation", Nucleic Acids Research, vol. 12, Issue 22, Nov. 26, 1984, pp. 8711-8721.
Bilang, et al., "The 3?- terminal region of the hygromycin-B-resistance gene is important for its activity in *Escherichia coli* and *Nicotiana tabacum*", Gene, vol. 100, Apr. 1991, pp. 247-250.
Bock, "Transgenic Plastids in Basic Research and Plant Biotechnology", Journal of Molecular Biology, vol. 312, Issue 3, Sep. 2001, pp. 425-438.
Boglioli, et al., "Rewriting the book of life: a new era in precision genome editing", The Boston Consulting Group, Sep. 2015, 28 pages.
Brown et al., "Lac repressor can regulate expression from a hybrid SV40 early promoter containing a lac operator in animal cells", Cell, vol. 49, Issue 5, Jun. 5, 1987, pp. 603-612.
Buchman et al., "Comparison of intron-dependent and intron-independent gene expression", *Mol. Cell Biol.* 8(10): 4395-405 (1988).
Bytebier, et al., "T-DNA organization in tumor cultures and transgenic plants of the monocotyledon Asparagus officinalis", Proceedings of the National Academy of Sciences, vol. 84, Issue 15, Aug. 1, 1987, pp. 5345-5349.
Callis et al., "Introns increase gene expression in cultured maize cells", Genes & Development, vol. 1, Issue 10, 1988, pp. 1183-1200.
Campanella et al., "MatGAT: An application that generates similarity/identity matrices using protein or DNA sequences", BMC Tioinformatics, vol. 4, Issue 29, 2003, pp. 1-4.
Campbell, et al., "Codon Usage in Higher Plants, Green Algae, and Cyanobacteria", Plant Physiology, vol. 92, 1990, pp. 1-11.
Canevascini et al., "Tissue-Specific Expression and Promoter Analysis of the Tobacco ltp1 Gene", Plant Physiology, vol. 112, Issue 2, Oct. 1996, pp. 513-524.
Casas, et al., "Transgenic sorghum plants via microprojectile bombardment", Proceedings of the National Academy of Sciences, vol. 90, Issue 23, Dec. 1993. pp. 11212-11216.
Chan et al., Agrobacterium-mediated production of transgenic rice plants expressing a chimeric alpha-amylase promoter/beta-glucuronidase gene, Plant Mol. Biol., 22(3):491-506 (Jun. 1993).
Chang et al., "Stable genetic transformation of *Arabidopsis thaliana* by Agrobacterium inoculation in planta", The Plant Journal, vol. 5, Issue 4, Apr. 1994, pp. 551-558.
Chee, et al., "Transformation of cucumber tissues by microprojectile bombardment: identification of plants containing functional and non-functional transferred genes", Gene, vol. 118, Issue 2, Sep. 1992, pp. 255-260.
Christensen et al., "Sequence analysis and transcriptional regulation by heat shock of polyubiquitin transcripts from maize", Plant Molecular Biology, vol. 12, Issue 6, Jun. 1989, pp. 619-632.
Christensen, et al., "Maize polyubiquitin genes: structure, thermal perturbation of expression and transcript splicing, and promoter activity following transfer to protoplasts by electroporation", Plant Molecular Biology, vol. 18, Issue 4, Feb. 1992, pp. 675-689.
Christopherson et al., "Ecdysteroid-dependent regulation of genes in mammalian cells by a *Drosophila ecdysone* receptor and chimeric transactivators", Proceedings of the National Academy of Sciences, vol. 89, Issue 14, 1992, pp. 6314-6318.

(56) References Cited

OTHER PUBLICATIONS

Christou, "Philosophy and practice of variety-independent gene transfer into recalcitrant crops", In Vitro Cellular & Developmental Biology—Plant, Jul. 1993, vol. 29, Issue 3, pp. 119-124.
Christou, et al., "Parameters Influencing Stable Transformation of Rice Immature Embryos and Recovery of Transgenic Plants using Electric Discharge Particle Acceleration", Annals of Botany, vol. 75, Issue 4, Apr. 1, 1995, pp. 407-413.
Christou, et al., "Stable Transformation of Soybean Callus by DNA-Coated Gold Particles", Plant Physiology, vol. 87, 1988, pp. 671-674.
Christou, et al., "The development of a variety-independent gene-transfer method for rice", Trends in Biotechnology, vol. 10, 1992, pp. 239-246.
Clark et al., "Mutations at the transit peptide-mature protein junction separate two cleavage events during chloroplast import of the chlorophyll a/b-binding protein", The Journal of Biological Chemistry, vol. 264, 1989, pp. 17544-17550.
Clough et al., "Floral dip: a simplified method for Agrobacterium-mediated transformation of *Arabidopsis thaliana*", The Plant Journal, vol. 16, Issue 6, Dec. 1998, pp. 735-743.
Cousins, et al., "Transformation of an Australian Cotton Cultivar: Prospects for Cotton Improvement Through Genetic Engineering", Australian Journal of Plant Physiology, vol. 18, Issue 5, 1991, pp. 481-494.
D'Halluin, et al., "Transformation of Sugarbeet (*Beta vulgaris* L.) and Evaluation of Herbicide Resistance in Transgenic Plants", Bio/Technology, vol. 10, 1992 pp. 309-314.
D'Halluin, et al., "Transgenic maize plants by tissue electroporation", The Plant Cell, vol. 4, 1992, pp. 1495-1505.
Datta, et al., "Genetically Engineered Fertile Indica-Rice Recovered from Protoplasts", Bio/Technology, 1990, vol. 8, pp. 736-740.
Davies, et al., "Transformation of peas", Plant Cell Reports, Jan. 1993, vol. 12, Issue 3, pp. 180-183.
De Block, "Genotype-independent leaf disc transformation of potato (*Solanum tuberosum*) using Agrobacterium tumefaciens", Theoretical and Applied Genetics, Nov. 1988, vol. 76, Issue 5, pp. 767-774.
De Block, et al., "Transformation of *Brassica napus* and *Brassica oleracea* Using Agrobacterium tumefaciens and the Expression of the bar and neo Genes in the Transgenic Plants", Plant Physiology, vol. 91, Issue 2, Oct. 1989, pp. 694-701.
Deblaere et al., "Efficient octopine Ti plasmid-derived vectors for Agrobacterium-mediated gene transfer to plants", Nucleic Acids Research, vol. 13, Issue 13, Jul. 11, 1985, pp. 4777-4788.
Degenkolb et al., "Structural requirements of tetracycline-Tet repressor interaction: determination of equilibrium binding constants for tetracycline analogs with the Tet repressor", Antimicrobial Agents and Chemotherapy, vol. 35, Issue 8, 1991, pp. 1591-1595.
Della-Cioppa et al., "Protein Trafficking in Plant Cells", Plant Physiology, vol. 84, Issue 4, Aug. 1987, pp. 965-968.
Desprez, et al., "Resistance against Herbicide Isoxaben and Cellulose Deficiency Caused by Distinct Mutations in Same Cellulose Synthase Isoform CESA6", Plant Physiology, vol. 128, Issue 2, Feb. 2002, pp. 482-490.
Deuschle et al., "Regulated expression of foreign genes in mammalian cells under the control of coliphage T3 RNA polymerase and lac repressor", Proceedings of the National Academy of Sciences, vol. 86, Issue 14, 1989, pp. 5400-5404.
Deuschle et al., "RNA polymerase II transcription blocked by *Escherichia coli* lac repressor", Science, vol. 248, Issue 4954, Apr. 27, 1990, pp. 480-483.
Dhir, et al., "Regeneration of Transgenic Soybean (*Glycine max*) Plants from Electroporated Protoplasts", Plant Physiology, vol. 99, 1992, pp. 81-88.
Dill et al., "Glyphosate-resistant crops: adoption, use and future considerations", Pest Management Science, vol. 64, Issue 4, Apr. 2008, pp. 326-331.

Dong, et al., "Transgenic flax plants from Agrobacterium mediated transformation: incidence of chimeric regenerants and inheritance of transgenic plants", Plant Science, vol. 91, Issue 2, 1993, pp. 139-148.
Eapen, et al., "Agrobacterium tumefaciens mediated gene transfer in peanut (*Arachis hypogaea* L.)", Plant Cell Reports, Jul. 1994, vol. 13, Issue 10, pp. 582-586.
Elroy-Stein et al., "Cap-independent translation of mRNA conferred by encephalomyocarditis virus 5' sequence improves the performance of the vaccinia virus/bacteriophage T7 hybrid expression system", Proceedings of the National Academy of Sciences, vol. 86, Issue 16, Aug. 1989, pp. 6126-6130.
Endler, et al., "Cellulose Synthases and Synthesis in *Arabidopsis*", Molecular Plant, vol. 4, Issue 2, Mar. 2011, pp. 199-211.
Esvelt, et al., "Genome?scale engineering for systems and synthetic biology", Molecular Systems Biology, vol. 9, 2013, pp. 1-17.
Feldmann et al., Agrobacterium-mediated transformation of germinating seeds of *Arabidopsis thaliana*: A non-tissue culture approach, Molecular Genetics and Genomics, vol. 208, Issue 1-2, 1987, pp. 1-9.
Figge et al., "Stringent regulation of stably integrated chloramphenicol acetyl transferase genes by *E. coli* lac repressor in monkey cells", Cell, vol. 52, Issue 5, Mar. 11, 1988, pp. 713-722.
Finer, et al., "Transformation of soybean via particle bombardment of embryogenic suspension culture tissue", In Vitro Cellular & Developmental Biology—Plant, Oct. 1991, vol. 27, Issue 4, pp. 175-182.
Frame et al., "Agrobacterium tumefaciens-Mediated Transformation of Maize Embryos Using a Standard Binary Vector System", Plant physiology, vol. 129, Issue 1, 2002, pp. 13-22.
Fromm, et al., "Inheritance and Expression of Chimeric Genes in the Progeny of Transgenic Maize Plants", Bio/Technology, vol. 8, 1990, pp. 833-839.
Fry, et al., "Transformation of *Brassica napus* with Agrobacterium tumefaciens based vectors", Plant Cell Reports, Oct. 1987, vol. 6, Issue 5, pp. 321-325.
Fuerst et al., "Transfer of the inducible lac repressor/operator system from *Escherichia coli* to a vaccinia virus expression vector", Proceedings of the National Academy of Sciences, vol. 86, Issue 8, pp. 2549-2553.
Gallie et al., "The Regulation of Gene Expression in Transformed Maize Aleurone and Endosperm Protoplasts (Analysis of Promoter Activity, Intron Enhancement, and mRNA Untranslated Regions on Expression)", Plant Physiology, vol. 106, Issue 3, Nov. 1994, pp. 929-939.
Gallie et al., "The tobacco etch viral 5? leader and poly(A) tail are functionally synergistic regulators of translation", Gene, vol. 165, Issue 2, 1995, pp. 233-238.
Gallie, et al., "A comparison of eukaryotic viral 5?-leader sequences as enhancers of mRNA expression in vivo", Nucleic Acids Research, vol. 15, Issue 21, Nov. 1987, pp. 8693-8711.
Gasteiger et al., "ExPASy: The proteomics server for in-depth protein knowledge and analysis", Nucleic Acids Research, vol. 31, Issue 13, 2003, pp. 3784-3788.
Geiser et al., "The hypervariable region in the genes coding for entomopathogenic crystal proteins of Bacillus thuringiensis: nucleotide sequence of the kurhd1 gene of subsp. *kurstaki* HD1", Gene, vol. 48, Isasue 1, 1986, pp. 109-118.
Gill et al., "Negative effect of the transcriptional activator GAL4", Nature, vol. 334, 1988, pp. 721-724.
Golovkin, et al., "Production of transgenic maize plants by direct DNA uptake into embryogenic protoplasts", Plant Science, vol. 90, Issue 1, 1993, pp. 41-52.
Gossen et al., "Tight control of gene expression in mammalian cells by tetracycline-responsive promoters", Proceedings of the National Academy of Sciences, vol. 89, Issue 12, 1992, pp. 5547-5551.
Green, "Evolution of Glyphosate-Resistant Crop Technology", Weed Science, vol. 57, Issue 1, 2009, pp. 108-117.
Green, et al., "New multiple-herbicide crop resistance and formulation technology to augment the utility of glyphosate", Pest Management Science, vol. 64, Issue 4, Apr. 2008, pp. 332-339.
Guerche, et al., "Direct gene transfer by electroporation in *Brassica napus*", Plant Science, vol. 52, Issues 1-2, 1987, pp. 111-116.

(56) References Cited

OTHER PUBLICATIONS

Guerineau, et al., "Effect of deletions in the cauliflower mosaic virus polyadenylation sequence on the choice of the polyadenylation sites in tobacco protoplasts", Molecular and General Genetics MGG, vol. 226, Issue 1-2, Apr. 1991, pp. 141-144.
Guevara-Garcia, et al., "Tissue?specific and wound?inducible pattern of expression of the mannopine synthase promoter is determined by the interaction between positive and negative cis? regulatory elements", The Plant Journal, vol. 4, Issue 3, Sep. 1993, pp. 495-505.
Guo, et al., "Transgenic Plants Obtained From Wheat Protoplasts Transformed by PEG-mediated Direct Gene Transfer", Chinese Science Bulletin, vol. 38, Issue 24, 1993, pp. 2072-2078.
Hansen, et al., "Wound-inducible and organ-specific expression of ORF13 from Agrobacterium rhizogenes; 8196 T-DNA in transgenic tobacco plants", Molecular and General Genetics MGG, vol. 254, Issue 3, Apr. 1997, pp. 337-343.
Hartman, et al., "Herbicide Resistant Turfgrass (*Agrostis palustris Huds.*) by Biolistic Transformation", Bio/Technology, vol. 12, 1994, pp. 919-923.
Heim, et al., "Mutation of a Locus of *Arabidopsis thaliana* Confers Resistance to the Herbicide Isoxaben", Plant Physiology, vol. 90, 1989, pp. 146-150.
Hiei, et al., "Efficient transformation of rice (*Oryza sativa* L.) mediated by Agrobacterium and sequence analysis of the boundaries of the T-DNA", The Plant Journal, vol. 6, Issue 2, Aug. 1994, pp. 271-282.
Hofgen, et al., "Storage of competent cells for Agrobacterium transformation", Nucleic Acids Research, vol. 16, Issue 20, Oct. 25, 1988, p. 9877.
Horsch et al., "A Simple and General Method for Transferring Genes into Plants", Science, vol. 227, Issue 4691, 1985, pp. 1229-1231.
Howell, et al., "Cloned Cauliflower Mosaic Virus DNA Infects Turnips (*Brassica rapa*)", Science, vol. 208, Issue 4449, Jun. 1980, pp. 1265-1267.
Hruz, et al., "Genevestigator V3: A Reference Expression Database for the Meta-Analysis of Transcriptomes", Advances in Bioinformatics, vol. 2008, pp. 1-5.
Hu, et al., "The inducible lac operator-repressor system is functional in mammalian cells", Cell, vol. 48, Issue 4, Feb. 27, 1987, pp. 555-566.
Hulo, et al., "Recent improvements to the PROSITE database", Nucleic Acids Research, vol. 32, Issue suppl. 1, 2004, D134-D137.
International Search Report for PCT Patent Application No. PCT/IB2016/056349, dated Feb. 20, 2017, 5 pages.
Inui, et al., "Herbicide resistance in transgenic plants with mammalian P450 monooxygenase genes", Pest Management Science, vol. 61, Issue 3, Mar. 2005, pp. 286-291.
Ishida, et al., "High efficiency transformation of maize (*Zea mays* L.) mediated by Agrobacterium tumefaciens", Nature Biotechnology, vol. 14, Issue 6, pp. 745-750 (1996).
Jobling, et al., "Enhanced translation of chimaeric messenger RNAs containing a plant viral untranslated leader sequence", Nature, vol. 325, 1987, pp. 622-625.
Joshi, "Putative polyadenylation signals in nuclear genes of higher plants: a compilation and analysis", Nucleic Acids Research, vol. 15, Issue 23, Dec. 10, 1987, pp. 9627-9640.
Kaeppler, et al., "Silicon carbide fiber-mediated DNA delivery into plant cells", Plant Cell Reports, vol. 9, Issue 8, Dec. 1990, pp. 415-418.
Kaeppler, et al., "Silicon carbide fiber-mediated stable transformation of plant cells", Theoretical and Applied Genetics, vol. 84, Issues 5-6, Aug. 1992, pp. 560-566.
Katavic, et al., "In planta transformation of *Arabidopsis thaliana*", Molecular and General Genetics MGG, vol. 245, Issue 3, May 1994, pp. 363-370.
Kawamata, et al., "Temporal and Spatial Pattern of Expression of the Pea Phenylalanine Ammonia-Lyase Gene1 Promoter in Transgenic Tobacco", Plant and Cell Physiology, vol. 38, Issue 7, Jan. 1997, pp. 792-803.
Klaus, et al., "Generation of marker-free plastid transformants using a transiently cointegrated selection gene", Nature Biotechnology, vol. 22, 2004, pp. 225-229.
Klein, et al., "Factors Influencing Gene Delivery into *Zea mays* Cells by High-Velocity Microprojectiles", Bio/Technology, 1988, vol. 6, 1988, pp. 559-563.
Klein, et al., "Genetic Transformation of Maize Cells by Particle Bombardment", Plant Physiology, vol. 91, 1989, pp. 440-444.
Klein, et al., "High-velocity microprojectiles for delivering nucleic acids into living cells", Nature, May 1987, vol. 327, pp. 70-73.
Klein, et al., "Transfer of foreign genes into intact maize cells with high-velocity microprojectiles", Proceedings of the National Academy of Sciences, Jun. 1, 1988, vol. 85, Issue 12, pp. 4305-4309.
Kleinschmidt, et al., "Dynamics of repressor-operator recognition: Tn10-encoded tetracycline resistance control", Biochemistry, vol. 27, Issue 4, 1988, pp. 1094-1104.
Koncz, et al., "The promoter of TL-DNA gene 5 controls the tissue-specific expression of chimaeric genes carried by a novel type of Agrobacterium binary vector", Molecular and General Genetics, Sep. 1986, vol. 204, Issue 3, pp. 383-396.
Kunkel, "Rapid and efficient site-specific mutagenesis without phenotypic selection", Proceedings of the National Academy of Sciences, vol. 82, Issue 2, Jan. 1985. pp. 488-492.
Kunkel, et al., "Rapid and efficient site-specific mutagenesis without phenotypic selection", Methods in Enzymology, vol. 154, 1987, pp. 367-382.
Labow, et al., "Conversion of the lac repressor into an allosterically regulated transcriptional activator for mammalian cells", Molecular and Cellular Biology, vol. 10, Issue 7, Jul. 1990, pp. 3343-3356.
Lam, "Analysis of Tissue-Specific Elements in the CaMV 35S Promoter", Plant Promoters and Transcription Factors, 1994, pp. 181-196.
Lamppa, "The chlorophyll a/b-binding protein inserts into the thylakoids independent of its cognate transit peptide", The Journal of Biological Chemistry, Oct. 1988, vol. 263, pp. 14996-14999.
Larkin, et al., "Clustal W and Clustal X version 2.0", Bioinformatics, vol. 23, Issue 21, 2007, pp. 2947-2948.
Last, et al., "pEmu: an improved promoter for gene expression in cereal cells", Theoretical and Applied Genetics, vol. 81, Issue 5, May 1991, pp. 581-588.
Lawrence, et al., "Alterations in the Chlamydomonas Plastocyanin Transit Peptide Have Distinct Effects on in VitroImport and in Vivo Protein Accumulation", The Journal of Biological Chemistry, vol. 272, Issue 33, 1997, pp. 20357-20363.
Letunic, et al., "Recent improvements to the SMART domain-based sequence annotition resource", Nucleic Acids Research, vol. 30, Issue 1, 2002, pp. 242-244.
Li, et al., "An improved rice transformation system using the biolistic method", Plant Cell Reports, Mar. 1993, vol. 12, Issue 5, pp. 250-255.
Li, et al., "Development of PPO inhibitor-resistant cultures and crops", Pest Management Science, vol. 61, Issue 3, Mar. 2005, pp. 277-285.
Lommel, et al., "Identification of the Maize chlorotic mottle virus capsid protein cistron and characterization of its subgenomic messenger RNA", Virology, vol. 181, Issue 1, Mar. 1991, pp. 382-385.
Macejak, et al., "Internal initiation of translation mediated by the 5? leader of a cellular mRNA", Nature, vol. 353, 1991, pp. 90-94.
Maliga, "Progress towards commercialization of plastid transformation technology", Trends in Biotechnology, vol. 21, Issue 1, Jan. 2003, pp. 20-28.
Matringe, et al., "p-Hydroxyphenylpyruvate dioxygenase inhibitor-resistant plants", Pest Management Science, vol. 61, Issue 3, Mar. 2005, pp. 269-276.
Matsuoka, et al., "Tissue-specific light-regulated expression directed by the promoter of a C4 gene, maize pyruvate, orthophosphate dikinase, in a C3 plant, rice", Proceedings of the National Academy of Sciences, vol. 90, Issue 20, 1993, pp. 9586-9590.

(56) References Cited

OTHER PUBLICATIONS

McBride, et al., "Controlled expression of plastid transgenes in plants based on a nuclear DNA-encoded and plastid-targeted T7 RNA polymerase", Proceedings of the National Academy of Sciences, vol. 91 Issue 15, 1994, pp. 7301-7305.
McCabe, et al., "Stable Transformation of Soybean (*Glycine max*) by Particle Acceleration", Bio/Technology, vol. 6, 1988, pp. 923-926.
McCormick, et al., "Leaf disc transformation of cultivated tomato (*L. esculentum*) using Agrobacterium tumefaciens", Plant Cell Reports, Apr. 1986, vol. 5, Issue 2, pp. 81-84.
McElroy, et al., "Isolation of an efficient actin promoter for use in rice transformation", The Plant Cell, vol. 2, Issue 2, Feb. 1990, pp. 163-171.
Mlynarova, et al., "High efficiency Agrobacterium-mediated gene transfer to flax", Plant Cell Reports, vol. 13, Issue 5, Feb. 1994, pp. 282-285.
Mogen, et al., "Upstream sequences other than AAUAAA are required for efficient messenger RNA 3'-end formation in plants", The Plant Cell, vol. 2, Issue 12, Dec. 1990, pp. 1261-1272.
Moloney, et al., "High efficiency transformation of *Brassica napus* using Agrobacterium vectors", Plant Cell Reports, vol. 8, Issue 4, Apr. 1989, pp. 238-242.
Mulder, et al., "The InterPro Database, 2003 brings increased coverage and new features", Nucleic Acids Research, vol. 31, Issue 1, 2003, pp. 315-318.
Munroe, et al., "Tales of poly(A): a review", Gene, vol. 91, Issue 2, Jul. 16, 1990, pp. 151-158.
Murashige, et al., "A Revised Medium for Rapid Growth and Bio Assays with Tobacco Tissue Cultures", Physiologia Plantarum, vol. 15, Issue 3, Jul. 1962, pp. 473-497.
Murray, et al., "Codon usage in plant genes", Nucleic Acids Research, vol. 17, Issue 2, Jan. 25, 1989, pp. 477-498.
Needleman, et al., "A general method applicable to the search for similarities in the amino acid sequence of two proteins", Journal of Molecular Biology, vol. 48, issue 3, pp. 443-453.
Neuhaus, et al., "Transgenic rapeseed plants obtained by the microinjection of DNA into microspore-derived embryoids", Theoretical and Applied Genetics, Dec. 1987, vol. 75, Issue 1, pp. 30-36.
Odell, et al., "Identification of DNA sequences required for activity of the cauliflower mosaic virus 35S promoter", Nature, vol. 313, pp. 810-812 (1985).
Oliva, et al., "Evidence that tetracycline analogs whose primary target is not the bacterial ribosome cause lysis of *Escherichia coli*", Antimicrobial Agents and Chemotherapy, vol. 36, Issue 5, 1992, pp. 913-919.
Orozco, et al., "Localization of light-inducible and tissue-specific regions of the spinach ribulose bisphosphate carboxylase/oxygenase (rubisco) activase promoter in transgenic tobacco plants", Plant Molecular Biology, vol. 23, Issue 6, Dec. 1993, pp. 1129-1138.
Padgette, et al., "Site-directed Mutagenesis of a Conserved Region of the; 5-Enolpyruvylshikimate-3-phosphate Synthase Active Site", Journal of Biological Chemistry, vol. 266, Issue 33, 1991, pp. 22364-22369.
Paszkowski, et al., "Direct gene transfer to plants", The EMBO Journal, vol. 3, Issue 12, Dec. 1984, pp. 2717-2722.
Potrykus, "Gene Transfer to Plants: Assessment of Published Approaches and Results", Annual Review of Plant Physiology and Plant Molecular Biology, vol. 42, 1991, pp. 205-225.
Proudfoot, "Poly(A) signals", Cell, vol. 64, Issue 4, 1991, pp. 671-674.
Puchta, et al., "Gene targeting in plants: 25 years later", The International Journal of Developmental Biology, vol. 57, 2013, pp. 629-637.
Reines, et al., "Elongation factor SII-dependent transcription by RNA polymerase II through a sequence-specific DNA-binding protein", Proceedings of the National Academy of Sciences, vol. 90, Issue 5, 1993, pp. 1917-1921.
Reznikoff, "The lactose operon?controlling elements: a complex paradigm", vol. 6, Issue 17, Sep. 1992, pp. 2419-2422.

Richmond, et al., "The Cellulose Synthase Superfamily", Plant Physiology, vol. 124, Oct. 2000, pp. 495-498.
Riggs, et al., "Stable transformation of tobacco by electroporation: evidence for plasmid concatenation", Proceedings of the National Academy of Sciences, Aug. 1, 1986, vol. 83, Issue 15, pp. 5602-5606.
Rinehart, et al., "Tissue-Specific and Developmental Regulation of Cotton Gene FbL2A (Demonstration of Promoter Activity in Transgenic Plants)", Plant Physiology, vol. 112, Issue 3, Nov. 1996, pp. 1331-1341.
Ritala, et al., "Fertile transgenic barley by particle bombardment of immature embryos", Plant Molecular Biology, Jan. 1994, vol. 24, Issue 2, pp. 317-325.
Romer, et al., "Expression of the Genes Encoding the Early Carotenoid Biosynthetic-Enzymes in Capsicum annuum", Biochemical and Biophysical Research Communications, vol. 196, Issue 3, Nov. 15, 1993, pp. 1414-1421.
Russell, et al., "Tissue-specific expression in transgenic maize of four endosperm promoters from maize and rice", Transgenic Research, Mar. 1997, vol. 6, Issue 2, pp. 157-168.
Sanfacon, et al., "A dissection of the cauliflower mosaic virus polyadenylation signal", Genes & Development, 1991, vol. 5, pp. 141-149.
Sanford, et al., "Delivery of substances into cells and tissues using a particle bombardment process", Particulate Science and Technology, vol. 5, Issue 1, 1987, pp. 27-37.
Scheible et al., Modifications of cellulose synthase confer resistance to isoxaben and thiazolidinone herbicides in *Arabidopsis* lxr1 mutants, Proc. Natl. Acad. Sci. USA, 98(18):10079-84 (2001).
Scheible, et al., "Modifications of cellulose synthase confer resistance to isoxaben and thiazolidinone herbicides in *Arabidopsis* lxr1 mutants", Proceedings of the National Academy of Sciences, Aug. 2001. vol. 98, Issue 18, pp. 10079-10084.
Scheid, et al., "Reversible inactivation of a transgene in *Arabidopsis thaliana*", Molecular and General Genetics, Aug. 1991, vol. 228, Issue 1-2, pp. 104-112.
Schliep, et al., "Phangorn: phylogenetic analysis in R", Bioinformatics, vol. 27, Issue 4, Feb. 2011, pp. 592-593.
Schmidt, et al., "A novel operon organization involving the genes for chorismate synthase (aromatic biosynthesis pathway) and ribosomal GTPase center proteins (L11, L1, L10, L12: rpIKAJL) in cyanobacterium Synechocystis PCC 6803", The Journal of Biological Chemistry, vol. 268, Issue 36, 1993, pp. 27447-27457.
Schnell, et al., "Signal peptide analogs derived from two chloroplast precursors interact with the signal recognition system of the chloroplast envelope", The Journal of Biological Chemistry, vol. 266, Issue 5, 1991, pp. 3335-3342.
Schultz, et al., "SMART, a simple modular architecture research tool: Identification of signaling domains", Proceedings of the National Academy of Sciences USA, vol. 95, Issue 11, May 1998, pp. 5857-5864.
Shah, et al., "Engineering Herbicide Tolerance in Transgenic Plants", Science, vol. 233, Issue 4762, Jul. 25, 1986, pp. 478-481.
Silva-Filho, et al., "Different in Vitro and in Vivo Targeting Properties of the Transit Peptide of a Chloroplast Envelope Inner Membrane Protein", The Journal of Biological Chemistry, vol. 272, Jun. 1997, pp. 15264-15269.
Siminszky, "Plant cytochrome P450-mediated herbicide metabolism", Phytochemistry Reviews, vol. 5, Issue 2-3, Jun. 2006, pp. 445-458.
Singh, et al., "Cytological characterization of transgenic soybean", Theoretical and Applied Genetics, Feb. 1998, vol. 96, Issue 2, pp. 319-324.
Skuzeski, et al., "Analysis of leaky viral translation termination codons in vivo by transient expression of improved ?-glucuronidase vectors", Plant Molecular Biology, vol. 15, Issue 1, Jul. 1990, pp. 65-79.
Slogteren, et al., "Expression of Ti plasmid genes in monocotyledonous plants infected with Agrobacterium tumefaciens", Nature, vol. 311, Oct. 1984, pp. 763-764.
Smith, et al., "Identification of Common Molecular Subsequences", Journal of Molecular Biology, vol. 147, Issue 1, Mar. 1981, pp. 195-197.

(56) References Cited

OTHER PUBLICATIONS

Staub, et al., "Accumulation of D1 polypeptide in tobacco plastids is regulated via the untranslated region of the psbA mRNA", The EMBO Journal, vol. 12, Issue 2, Feb. 1993, pp. 601-606.

Svab, et al., "Stable transformation of plastids in higher plants", Proceedings of the National Academy of Sciences, vol. 87, Issue 21, 1990, pp. 8526-8530.

Svab, et al., "High-frequency plastid transformation in tobacco by selection for a chimeric aadA gene", Proceedings of the National Academy of Sciences, vol. 90, Issue 3, 1993, pp. 913-917.

Tan, et al., "Imidazolinone-tolerant crops: history, current status and future", Pest Management Science, vol. 61, Issue 3, Mar. 2005, pp. 246-257.

Tan, et al., "Precision Editing of Large Animal Genomes", Advances in Genetics, vol. 80, 2012, pp. 37-97.

Terpe, et al., "Overview of tag protein fusions: from molecular and biochemical fundamentals to commercial systems", Applied Microbiology and Biotechnology, vol. 60, Issue 5, 2003, pp. 523-533.

Tomes, et al., "Direct DNA Transfer into Intact Plant Cells Via Microprojectile Bombardment", Plant Cell, Tissue and Organ Culture, 1995, pp. 197-213.

Van Camp, et al., "Tissue-Specific Activity of Two Manganese Superoxide Dismutase Promoters in Transgenic Tobacco", Plant Physiology, vol. 112, Issue 2, Oct. 1996, pp. 525-535.

Velten, et al., "Isolation of a dual plant promoter fragment from the Ti plasmid of Agrobacterium tumefaciens", The EMBO Journal, vol. 3, Issue 12, Dec. 1984, pp. 2723-2730.

Von Heijne, et al., "CHLPEP—A database of chloroplast transit peptides", Plant Molecular Biology Reporter, vol. 9, Issue 2, May 1991, pp. 104-126.

Wan, et al., "Generation of Large Nos. of Independently Transformed Fertile Barley Plants", Plant Physiology, vol. 104, 1994, pp. 37-48.

Weising, et al., "Foreign Genes in Plants: Transfer, Structure, Expression, and Applications", Annual Review of Genetics, vol. 22, Dec. 1988, pp. 421-477.

Williams, et al., "Differences in zoospore germination and host penetration in response to temperature among Western Australian isolates of Plasmopara viticola", Australian Journal of Agricultural Research, vol. 58, Issue 7, pp. 702-710.

Wyborski, et al., "Analysis of inducers of the *E.coli* lac repressor system mammalian cells and whole animals", Nucleic Acids Research, vol. 19, Issue 17, Sep. 11, 1991, pp. 4647-4653.

Yamamoto, et al., "Light?responsive elements of the tobacco PSI?D gene are located both upstream and within the transcribed region", The Plant Journal, vol. 12, Issue 2, Aug. 1997, pp. 255-265.

Yamamoto, et al., "The Promoter of a Pine Photosynthetic Gene Allows Expression of a ?-Glucuronidase Reporter Gene in Transgenic Rice Plants in a Light-Independent but Tissue-Specific Manner", Plant and Cell Physiology, vol. 35, Issue 5, Jan. 1, 1994, pp. 773-778.

Yao, et al., "*Drosophila ultraspiracle* modulates ecdysone receptor function via heterodimer formation", Cell, vol. 71, Issue 1, Oct. 1992, pp. 63-72.

Yarranton, 'Inducible vectors for expression in mammalian cells', Current Opinion in Biotechnology, vol. 3, Issue 5, Oct. 1992, pp. 506-511.

Zambretti, et al., "A mutant p53 protein is required for maintenance of the transformed phenotype in cells transformed with p53 plus ras cDNAs", Proceedings of the National Academy of Sciences, vol. 89, Issue 9, pp. 3952-3956 (1992).

Zhao, et al., "Immunological Characterization and Chloroplast Localization of the Tryptophan Biosynthetic Enzymes of the Flowering Plant *Arabidopsis thaliana*", The Journal of Biological Chemistry, vol. 270, Issue 11, pp. 6081-6087.

\* cited by examiner

Figure 2 A

```
                              *         20         *
At_CesA1         : LCFFLQYRTTHPKNAYPIWLTSVICEIWFAFSW : 34   SEQ ID NO: 99
BnaA01g04600D    : .G....................D......... : 34   SEQ ID NO:126
BnaC01g06090D    : .G....................D......... : 34   SEQ ID NO:126
BnaA03g52020D    : .G....................D......... : 34   SEQ ID NO:126
BnaC07g43790D    : .G....................D......... : 34   SEQ ID NO:126
Glyma04g07220    : .G.....V..............D........L : 34   SEQ ID NO:127
Glyma06g07320    : .G.....V..............D........L : 34   SEQ ID NO:127
Ha_CesA1         : .G.....CS............ND....V...L : 34   SEQ ID NO:128
At_CesA10        : GV..R.................D.A....... : 34   SEQ ID NO:129
GRMZM2G027723    : ...F..IS.............R..G..V.V..L : 34   SEQ ID NO:130
GRMZM2G112336    : ...F..VS.............R..G..V.V..L : 34   SEQ ID NO:131
Os05g08370.1     : .M.F..V..............PD.G..V...L : 34   SEQ ID NO:132
GRMZM2G039454    : ...F..I..............ED.G..V.V..L : 34   SEQ ID NO:133
At_CesA3         : .L..H.I.N............P..FA...V..L : 34   SEQ ID NO:134
BnaA03g55200D    : .L..H.I.N............P..FT...I.. : 34   SEQ ID NO:135
BnaC03g02050D    : .L..H.I.N............P..FT...I.. : 34   SEQ ID NO:135
BnaAnng01240D    : .L..H.I.N............P..FT...I.. : 34   SEQ ID NO:135
BnaC02g02440D    : .L..H.I.N............P..FT...I.. : 34   SEQ ID NO:135
Glyma09g15620    : .I..H.I.N............P...A...I..I : 34   SEQ ID NO:136
Glyma15g43040    : .I..H.I.N............P...A...I..I : 34   SEQ ID NO:136
Glyma12g36570    : .I..H.I.N............P.....V..I.. : 34   SEQ ID NO:137
Glyma13g27250    : .I..H.I.N............P.....V..I.. : 34   SEQ ID NO:137
Ha_CesA3         : .I..H.I.N.T..........L....I.. : 34   SEQ ID NO:138
GRMZM2G018241    : SI..H.I.N............R....L....L : 34   SEQ ID NO:139
GRMZM2G424832    : SI..H.I.N............R....L....L : 34   SEQ ID NO:139
Os07g10770.1     : SI..H.I.N............R....L....L : 34   SEQ ID NO:139
GRMZM2G111642    : .I..R.I...N..........L........L : 34   SEQ ID NO:140
Os03g59340.1     : .I..H.I.N............R....L....L : 34   SEQ ID NO:141
At_CesA2         : GL.FH..IL...ND..G..............V. : 34   SEQ ID NO:142
At_CesA9         : GL.FH..IL...ND.FG..............V. : 34   SEQ ID NO:143
At_CesA5         : GL.FH..IL...ND..A..............V. : 34   SEQ ID NO:144
At_CesA6         : GL.FH..IL....D..A..I...........V. : 34   SEQ ID NO:145
BnaA02g34360D    : SL.FH..IL....D..A..............V. : 34   SEQ ID NO:146
BnaC02g43280D    : SL.FH..IL....D..A..............V. : 34   SEQ ID NO:146
BnaA06g23700D    : GL.FH..IL....D..A..............V. : 34   SEQ ID NO:147
BnaC03g49550D    : GL.FH..IL....D..A..............V. : 34   SEQ ID NO:147
BnaA09g06990D    : GL.FH..IL....D..A..............V. : 34   SEQ ID NO:147
BnaC09g06600D    : GL.FH..IL....D..A..............V. : 34   SEQ ID NO:147
Glyma05g32100    : GL.FH..IL...ND..G..............V. : 34   SEQ ID NO:148
Glyma08g15380    : GL.FH..IL...ND..G..............V. : 34   SEQ ID NO:148
Glyma02g08920    : .L.FH..IL...ND..A..............V. : 34   SEQ ID NO:149
Glyma16g28080    : .L.FH..IL...ND..A..............V. : 34   SEQ ID NO:149
Glyma10g36790    : GL.FH..IL...ND..A..............V. : 34   SEQ ID NO:150
GRMZM2G025231    : .G.FH..VM...ND..FA..I..........M. : 34   SEQ ID NO:151
GRMZM2G028353    : .G.FH..VM...ND..FA..I..........M. : 34   SEQ ID NO:151
GRMZM2G113137    : ...FH..VM...PD..FA..I..........M. : 34   SEQ ID NO:152
Os03g62090.1     : .G.FH..VM...PD..FA..I..........M. : 34   SEQ ID NO:153
Os07g24190.1     : .G.FH..VM...PD..FA..I..........M. : 34   SEQ ID NO:153
Os07g24190.3     : .G.FH..VM...PD..FA..I..........M. : 34   SEQ ID NO:153
GRMZM2G062580    : .G.FH..VM...A.D.FA..I..........M. : 34   SEQ ID NO:154
GRMZM2G177631    : .G.FH..VM...A.D.FA..I..........M. : 34   SEQ ID NO:154
Os07g14850.1     : .G.FH..VM...ND..FA..I..........M. : 34   SEQ ID NO:155
Os07g24190.2     : .G.FH..VM...PD..FA..I..........M. : 34   SEQ ID NO:156
Ha_CesA3b_fragm  : GL.FH..IL...ND..A..I...........V. : 34   SEQ ID NO:157
```

Figure 2B

| Name | | Seq | | SEQ ID |
|---|---|---|---|---|
| At_CesA1 | : | XCILPRFCLITDRPLIEESNYAIWFILIXI- | : 34 | SEQ ID NO:102 |
| BnaA01g04600D | : | ............................- | : 34 | SEQ ID NO:158 |
| BnaC01g06090D | : | ............................- | : 34 | SEQ ID NO:158 |
| BnaA03g52020D | : | ............................- | : 34 | SEQ ID NO:158 |
| BnaC07g43790D | : | ............................- | : 34 | SEQ ID NO:158 |
| Glyma04g07220 | : | T......N......F..M.......V.- | : 34 | SEQ ID NO:159 |
| Glyma06g07320 | : | T......N......F..M.......V.- | : 34 | SEQ ID NO:159 |
| Ha_Cesa1 | : | V....V..G.........M.........- | : 34 | SEQ ID NO:160 |
| At_CesA10 | : | N......NT......LLCM....A...- | : 34 | SEQ ID NO:161 |
| GRMZM2G027723 | : | V...I...N..........GMF...A..- | : 34 | SEQ ID NO:162 |
| GRMZM2G112336 | : | V...I...N..........GMF...A..- | : 34 | SEQ ID NO:162 |
| Os05g08370.1 | : | V...I...N..........GMF...A..- | : 34 | SEQ ID NO:162 |
| GRMZM2G039454 | : | V...I.......A......GAF...A..- | : 34 | SEQ ID NO:163 |
| At_CesA3 | : | T..V..F.NQ....Q..I....LS..L.- | : 34 | SEQ ID NO:164 |
| BnaA03g55200D | : | T..V..F.NQ....Q..I....LS..L.- | : 34 | SEQ ID NO:164 |
| BnaC03g02050D | : | T..V..F.NQ....Q..I....LS..L.- | : 34 | SEQ ID NO:164 |
| BnaAnng01240D | : | T..V..F.NQ....Q..I....LS..L.- | : 34 | SEQ ID NO:164 |
| BnaC02g02440D | : | T..V..F.NQ....Q..I....LS..L.- | : 34 | SEQ ID NO:164 |
| Glyma09g15620 | : | T..V..N......Q..I.....S..L.- | : 34 | SEQ ID NO:165 |
| Glyma15g43040 | : | T..V..N......Q..I.....S..L.- | : 34 | SEQ ID NO:165 |
| Glyma12g36570 | : | ...V..N......Q..L.....S..L.- | : 34 | SEQ ID NO: 166 |
| Glyma13g27250 | : | ...V..N......Q..L.....S..L.- | : 34 | SEQ ID NO: 166 |
| Ha_Cesa3 | : | T..V..G......Q..L.L...S..L.- | : 34 | SEQ ID NO: 167 |
| GRMZM2G018241 | : | ...I...G........F.....S..L.- | : 34 | SEQ ID NO: 168 |
| GRMZM2G424832 | : | ...I...G........F.....S..L.- | : 34 | SEQ ID NO: 168 |
| Os07g10770.1 | : | V..I...G........F.....S..L.- | : 34 | SEQ ID NO: 169 |
| GRMZM2G150404 | : | ...I...G........F.....S..L.- | : 34 | SEQ ID NO: 167 |
| GRMZM2G111642 | : | ...V...G........F..LE.V..S..L.- | : 34 | SEQ ID NO: 170 |
| Os03g59340.1 | : | ...I...G........F.....S..L.- | : 34 | SEQ ID NO: 171 |
| At_CesA2 | : | S..V...G........V.....G.L.M..- | : 34 | SEQ ID NO: 172 |
| At_CesA9 | : | S..I...G........V.....G.L.M.K- | : 34 | SEQ ID NO: 173 |
| At_CesA5 | : | S..I...G........V......L.MA.G- | : 34 | SEQ ID NO: 174 |
| At_CesA6 | : | S..I...G........V......L.MA.S- | : 34 | SEQ ID NO: 175 |
| BnaA02g34360D | : | S..I...G........V......L.MA.S- | : 34 | SEQ ID NO: 175 |
| BnaC02g43280D | : | S..I...G........V......L.MA.S- | : 34 | SEQ ID NO: 175 |
| BnaA06g23700D | : | S..I...G........V......L.MA.S- | : 34 | SEQ ID NO: 175 |
| BnaC03g49550D | : | S..I...G........V......L.MA.S- | : 34 | SEQ ID NO: 175 |
| BnaA09g06990D | : | S..I...G........V......L.MA.S- | : 34 | SEQ ID NO: 175 |
| BnaC09g06600D | : | S..I...G........V......L.MA.S- | : 34 | SEQ ID NO: 175 |
| Glyma05g32100 | : | T..I...G........V......V.MA..- | : 34 | SEQ ID NO: 176 |
| Glyma08g15380 | : | T..I...G........V....LV.MA..- | : 34 | SEQ ID NO: 177 |
| Glyma02g08920 | : | A..V...G........V......I.MA..- | : 34 | SEQ ID NO: 178 |
| Glyma16g28080 | : | A..V...G........V......I.MA..- | : 34 | SEQ ID NO: 178 |
| Glyma10g36790 | : | T..V...G........V......I.MA..- | : 34 | SEQ ID NO: 178 |
| GRMZM2G025231 | : | T..I...G......T.LN.V.L..MS..C- | : 34 | SEQ ID NO: 179 |
| GRMZM2G028353 | : | T..I...G......T.LN.V.L..MS..C- | : 34 | SEQ ID NO: 179 |
| GRMZM2G113137 | : | T..I...G......T.LN.V.L..MS..C- | : 34 | SEQ ID NO: 179 |
| Os03g62090.1 | : | T..I...G......T.LT.I.L..MS..C- | : 34 | SEQ ID NO: 180 |
| Os07g24190.1 | : | T..I...G......T.LT.V.L..MS..C- | : 34 | SEQ ID NO: 181 |
| Os07g24190.3 | : | T..I...G......T.LT.V.L..MS..C- | : 34 | SEQ ID NO: 181 |
| GRMZM2G177631 | : | T..I...G......T.LT.V...MA..C- | : 34 | SEQ ID NO: 182 |
| Os07g14850.1 | : | T..I...G......T.LT.V.L..MS..C- | : 34 | SEQ ID NO: 183 |
| Os07g24190.2 | : | T..I...G......T.LT.V.L..MS..C- | : 34 | SEQ ID NO: 183 |
| Glyma06g47420 | : | T..I........L.A.GM.VS..FC- | : 34 | SEQ ID NO: 184 |
| Ha_Cesa3b_fragm | : | T..V...G....Q..I.L.--------- | : 27 | SEQ ID NO: 185 |
| Ha_Cesa6_fragme | : | T..V...G......V.....L.M.M.L.- | : 34 | SEQ ID NO: 186 |

Figure 2C

| Name | | Seq | | SEQ ID |
|---|---|---|---|---|
| At_CesA1 | : | VIGGTSAHIRAVRGCILKVIAGIINFFVYSK | : 32 | SEQ ID NO:105 |
| BnaA01g04600D | : | | : 32 | SEQ ID NO:105 |
| BnaC01g06090D | : | | : 32 | SEQ ID NO:105 |
| BnaA03g52020D | : | | : 32 | SEQ ID NO:105 |
| BnaC07g43790D | : | | : 32 | SEQ ID NO:105 |
| Glyma04g07220 | : | | : 32 | SEQ ID NO:105 |
| Glyma06g07320 | : | | : 32 | SEQ ID NO:105 |
| Ha_Cesa1 | : | | : 32 | SEQ ID NO:105 |
| At_CesA10 | : | ......................F...... | : 32 | SEQ ID NO:187 |
| GRMZM2G027723 | : | | : 32 | SEQ ID NO:105 |
| GRMZM2G112336 | : | | : 32 | SEQ ID NO:105 |
| Os05g08370.1 | : | | : 32 | SEQ ID NO:105 |
| GRMZM2G039454 | : | | : 32 | SEQ ID NO:105 |
| At_CesA3 | : | ....V........I................ | : 32 | SEQ ID NO:188 |
| BnaA03g55200D | : | ....V......................... | : 32 | SEQ ID NO:189 |
| BnaC03g02050D | : | ....V......................... | : 32 | SEQ ID NO:189 |
| BnaAnng01240D | : | ....V......................... | : 32 | SEQ ID NO:189 |
| BnaC02g02440D | : | ....V......................... | : 32 | SEQ ID NO:189 |
| Glyma09g15620 | : | ....V......................... | : 32 | SEQ ID NO:189 |
| Glyma15g43040 | : | ....V......................... | : 32 | SEQ ID NO:189 |
| Glyma12g36570 | : | ....V......................... | : 32 | SEQ ID NO:189 |
| Glyma13g27250 | : | ....V......................... | : 32 | SEQ ID NO:189 |
| Ha_Cesa3 | : | ....V......................... | : 32 | SEQ ID NO:189 |
| GRMZM2G018241 | : | ....I......................... | : 32 | SEQ ID NO:190 |
| GRMZM2G424832 | : | ....I......................... | : 32 | SEQ ID NO:190 |
| Os07g10770.1 | : | ....I......................... | : 32 | SEQ ID NO:190 |
| GRMZM2G150404 | : | ....I......................... | : 32 | SEQ ID NO:190 |
| GRMZM2G111642 | : | ....I....................S.... | : 32 | SEQ ID NO:191 |
| Os03g59340.1 | : | ....I....................S.... | : 32 | SEQ ID NO:191 |
| At_CesA2 | : | ....A.S.....L........VN....... | : 32 | SEQ ID NO:192 |
| At_CesA9 | : | ....V.S.....L........VS....... | : 32 | SEQ ID NO:193 |
| At_CesA5 | : | ....V.S.....L........VE....... | : 32 | SEQ ID NO:194 |
| At_CesA6 | : | ....V.S.....L........V........ | : 32 | SEQ ID NO:195 |
| BnaA02g34360D | : | ....V.S.....L........V........ | : 32 | SEQ ID NO:195 |
| BnaC02g43280D | : | ....V.S.....L........V........ | : 32 | SEQ ID NO:195 |
| BnaA06g23700D | : | ....V.S.....L........V........ | : 32 | SEQ ID NO:195 |
| BnaC03g49550D | : | ....V.S.....L........V........ | : 32 | SEQ ID NO:195 |
| BnaA09g06990D | : | ....V.S.....L........V........ | : 32 | SEQ ID NO:195 |
| BnaC09g06600D | : | ....V.S.....L........V........ | : 32 | SEQ ID NO:195 |
| Glyma05g32100 | : | ....V.S.....L........VN....... | : 32 | SEQ ID NO:196 |
| Glyma08g15380 | : | ....V.S.....L........VN....... | : 32 | SEQ ID NO:196 |
| Glyma02g08920 | : | ....A.S.....L........VN....... | : 32 | SEQ ID NO:197 |
| Glyma16g28080 | : | ....A.S.....L........VN....... | : 32 | SEQ ID NO:197 |
| Glyma10g36790 | : | ....A.S.....L........VN....... | : 32 | SEQ ID NO:197 |
| GRMZM2G025331 | : | ....V.S.............I..V..S... | : 32 | SEQ ID NO:198 |
| GRMZM2G028353 | : | ....V.S.............I..V..S... | : 32 | SEQ ID NO:198 |
| GRMZM2G113137 | : | ....V.S.............I..V..S... | : 32 | SEQ ID NO:198 |
| Os03g62090.1 | : | ....V.S.............I..V..S... | : 32 | SEQ ID NO:199 |
| Os07g24190.1 | : | ....V.S.............I..V..S... | : 32 | SEQ ID NO:200 |
| Os07g24190.3 | : | ....V.S.............I..V..S... | : 32 | SEQ ID NO:200 |
| GRMZM2G177631 | : | ....V.S...........F....V..S... | : 32 | SEQ ID NO:201 |
| Os07g14850.1 | : | ....V.S................V..S... | : 32 | SEQ ID NO:202 |
| Os07g24190.2 | : | ....V.S.....L.......I...S..... | : 32 | SEQ ID NO:203 |
| Glyma06g47420 | : | ....V..FL...L.ME.....VK...L.A. | : 32 | SEQ ID NO:204 |
| Ha_Cesa6_fragme | : | ....V.......LV.......VN....... | : 32 | SEQ ID NO:205 |

Figure 2D

| Name | Sequence (pos ~20) | Pos | SEQ ID |
|---|---|---|---|
| At_CesA1 | AVMSGQCSWGFLFGKLFTLWVVAHLYPFLKGLLG | 35 | SEQ ID NO:108 |
| BnaA01g04600D | | 35 | SEQ ID NO:206 |
| BnaC01g06090D | | 35 | SEQ ID NO:206 |
| BnaA03g52020D | ...........................M | 35 | SEQ ID NO:207 |
| BnaC07g43790D | ...........................M | 35 | SEQ ID NO:207 |
| Glyma04g07220 | ..................I........ | 35 | SEQ ID NO:208 |
| Glyma06g07320 | ..................I........ | 35 | SEQ ID NO:208 |
| Ha_Cesa1 | ..................I..V...... | 35 | SEQ ID NO:209 |
| At_CesA10 | ..........M..L..F..V....... | 35 | SEQ ID NO:210 |
| GRMZM2G027723 | ................SI..L......M | 35 | SEQ ID NO:211 |
| GRMZM2G112336 | ................SI..L......M | 35 | SEQ ID NO:211 |
| Os05g08370.1 | ................SI..L......M | 35 | SEQ ID NO:211 |
| GRMZM2G039454 | ..................I..L......M | 35 | SEQ ID NO:212 |
| At_CesA3 | ..................F..V......M | 35 | SEQ ID NO:213 |
| BnaA03g55200D | ..................F..V......M | 35 | SEQ ID NO:213 |
| BnaC03g02050D | ..................F..V......M | 35 | SEQ ID NO:213 |
| BnaAnng01240D | ..................F..V......M | 35 | SEQ ID NO:213 |
| BnaC02g02440D | ..................F..V......M | 35 | SEQ ID NO:213 |
| Glyma09g15620 | ..................F..I......M | 35 | SEQ ID NO:214 |
| Glyma15g43040 | ..................F..I......M | 35 | SEQ ID NO:214 |
| Glyma12g36570 | ..................F..I......M | 35 | SEQ ID NO:214 |
| Glyma13g27250 | ..................F..I......M | 35 | SEQ ID NO:214 |
| Ha_Cesa3 | ..................F..V......M | 35 | SEQ ID NO:215 |
| GRMZM2G018341 | ..................F..V......M | 35 | SEQ ID NO:215 |
| GRMZM2G424833 | ..................F..V......M | 35 | SEQ ID NO:215 |
| Os07g10770.1 | ..................F..V......M | 35 | SEQ ID NO:215 |
| GRMZM2G150404 | ..................F..V......M | 35 | SEQ ID NO:215 |
| GRMZM2G111642 | ..................F..V......M | 35 | SEQ ID NO:215 |
| Os03g59340.1 | ..................F..V......M | 35 | SEQ ID NO:215 |
| At_CesA2 | SN..D.....R.........V.....M. | 35 | SEQ ID NO:216 |
| At_CesA9 | SN..D.....R.........V....... | 35 | SEQ ID NO:217 |
| At_CesA5 | SN..D.....R......F..L....... | 35 | SEQ ID NO:218 |
| At_CesA6 | SN..D.....R.........I....... | 35 | SEQ ID NO:219 |
| BnaA02g34360D | SN..D.....R.........VI...... | 35 | SEQ ID NO:220 |
| BnaC02g43280D | SN..D.....R.........VI...... | 35 | SEQ ID NO:220 |
| BnaA06g23700D | SN..D.....R.........VI...... | 35 | SEQ ID NO:220 |
| BnaC03g49550D | SN..D.....R.........VI...... | 35 | SEQ ID NO:220 |
| BnaA09g06990D | SN..D.....R.........VI...... | 35 | SEQ ID NO:220 |
| BnaC09g06600D | SN..D.....R.........VI...... | 35 | SEQ ID NO:220 |
| Glyma05g32100 | .N..D.....R.........L....... | 35 | SEQ ID NO:221 |
| Glyma08g15380 | .N..D.....R.........L....... | 35 | SEQ ID NO:221 |
| Glyma02g08920 | .N..D.....R.........V....VM. | 35 | SEQ ID NO:222 |
| Glyma16g28080 | .N..D.....R.........V....VM. | 35 | SEQ ID NO:222 |
| Glyma10g36790 | .N..D.....R.........V....VM. | 35 | SEQ ID NO:223 |
| GRMZM2G025231 | .N..E...............F..V...V | 35 | SEQ ID NO:224 |
| GRMZM2G028353 | .N..E...............F..V...V | 35 | SEQ ID NO:224 |
| GRMZM2G113137 | .N..E...............F..V...V | 35 | SEQ ID NO:224 |
| Os03g62090.1 | .N..E...............F..V...V | 35 | SEQ ID NO:224 |
| Os07g24190.1 | .N..E...............F..V...V | 35 | SEQ ID NO:224 |
| Os07g24190.3 | .N..E...............F..V...V | 35 | SEQ ID NO:224 |
| GRMZM2G177631 | .N..E...............F..V...V | 35 | SEQ ID NO:224 |
| Os07g14850.1 | .N..E...............F..V...V | 35 | SEQ ID NO:224 |
| Os07g24190.2 | .N..E...............F..V...V | 35 | SEQ ID NO:224 |
| Glyma06g47420 | .N.FE....L...L.S....L.....MI | 35 | SEQ ID NO:225 |

Figure 2E

```
At_CesA1        : IWAGVSYAVWSG : 14  SEQ ID NO:123
BnaA01g04600D   : .............  : 14  SEQ ID NO:226
BnaC01g06090D   : .............  : 14  SEQ ID NO:226
BnaA03g52020D   : .............  : 14  SEQ ID NO:123
BnaC07g43790D   : .............  : 14  SEQ ID NO:123
Glyma04g07220   : .............  : 14  SEQ ID NO:226
Glyma06g07320   : .............  : 14  SEQ ID NO:226
Ha_Cesa1        : ..S...T......  : 14  SEQ ID NO:227
At_CesA10       : .............  : 14  SEQ ID NO:226
GRMZM2G027723   : M...I........  : 14  SEQ ID NO:228
GRMZM2G112336   : M...I........  : 14  SEQ ID NO:228
Os05g08370.1    : M...I........  : 14  SEQ ID NO:228
GRMZM2G039454   : .............  : 14  SEQ ID NO:226
At_CesA3        : V............  : 14  SEQ ID NO:229
BnaA03g55200D   : V...F........  : 14  SEQ ID NO:230
BnaC03g02050D   : V...F........  : 14  SEQ ID NO:230
BnaAnng01240D   : V...F........  : 14  SEQ ID NO:230
BnaC02g02440D   : V...F........  : 14  SEQ ID NO:230
Glyma09g15620   : V...I........  : 14  SEQ ID NO:231
Glyma15g43040   : V...I........  : 14  SEQ ID NO:231
Glyma12g36570   : V...I........  : 14  SEQ ID NO:231
Glyma13g27250   : V...I........  : 14  SEQ ID NO:231
Ha_Cesa3        : V...I........  : 14  SEQ ID NO:231
GRMZM2G018241   : V...I........  : 14  SEQ ID NO:231
GRMZM2G424832   : V...I........  : 14  SEQ ID NO:231
Os07g10770.1    : V...I........  : 14  SEQ ID NO:231
GRMZM2G150404   : V...I........  : 14  SEQ ID NO:231
GRMZM2G111642   : V...I........  : 14  SEQ ID NO:231
Os03g59340.1    : V...I........  : 14  SEQ ID NO:231
At_CesA2        : VIV..D..SN...  : 14  SEQ ID NO:232
At_CesA9        : VIV..D..SN...  : 14  SEQ ID NO:233
At_CesA5        : VIV..D..SN...  : 14  SEQ ID NO:234
At_CesA6        : VIV..D..SN...  : 14  SEQ ID NO:232
BnaA02g34360D   : ..V.I.D..SN..  : 14  SEQ ID NO:235
BnaC02g43280D   : ..V.I.D..SN..  : 14  SEQ ID NO:235
BnaA06g23700D   : ..V.I.D..SN..  : 14  SEQ ID NO:235
BnaC03g49550D   : ..V.I.D..SN..  : 14  SEQ ID NO:235
BnaA09g06990D   : ..V.I.D..SN..  : 14  SEQ ID NO:235
BnaC09g06600D   : ..V.I.D..SN..  : 14  SEQ ID NO:235
Glyma05g32100   : V.V..D..N....  : 14  SEQ ID NO:236
Glyma08g15380   : V.V.I.D..N...  : 14  SEQ ID NO:237
Glyma02g08920   : VIV...D..N...  : 14  SEQ ID NO:238
Glyma16g28080   : VIV...D..N...  : 14  SEQ ID NO:238
Glyma10g36790   : VIV...D..N...  : 14  SEQ ID NO:238
GRMZM2G025231   : V.....N..N...  : 14  SEQ ID NO:239
GRMZM2G028353   : V.....N..N...  : 14  SEQ ID NO:239
GRMZM2G113137   : V....I.N..N..  : 14  SEQ ID NO:240
Os03g62090.1    : V......N..N..  : 14  SEQ ID NO:241
Os07g24190.1    : V......N..N..  : 14  SEQ ID NO:241
Os07g24190.3    : V......N..N..  : 14  SEQ ID NO:241
GRMZM2G177631   : V....I.N..N..  : 14  SEQ ID NO:240
Os07g14850.1    : V......N..N..  : 14  SEQ ID NO:241
Os07g24190.2    : V......N..N..  : 14  SEQ ID NO:241
Glyma06g47420   : AV......N..F. : 14  SEQ ID NO:242
```

Figure 2F

```
                                      *        20
At_CesA1         : VIV VL A IFSL WV  NPF  : 22    SEQ ID NO:124
BnaA01g04600D    : ... .. . .... ..  ...  : 22    SEQ ID NO:124
BnaC01g06090D    : ... .. . .... ..  ...  : 22    SEQ ID NO:124
BnaA03g52020D    : ... .. . .... ..  ...  : 22    SEQ ID NO:124
BnaC07g43790D    : ... .. . .... ..  ...  : 22    SEQ ID NO:124
Glyma04g07220    : ... .. . .... ..  D..  : 22    SEQ ID NO:243
Glyma06g07320    : ... .. . .... ..  D..  : 22    SEQ ID NO:243
Ha_Cesa1         : ... I. . .... ..  D..  : 22    SEQ ID NO:244
At_CesA10        : ... A. . .... ..  ...  : 22    SEQ ID NO:245
GRMZM2G027723    : ... I. . .... .. F D.. : 22    SEQ ID NO:246
GRMZM2G112336    : ... I. . .... .. F D.. : 22    SEQ ID NO:246
Os05g08370.1     : ... I. . .... .. K D.. : 22    SEQ ID NO:246
GRMZM2G039454    : ... .. . .... .. K D.. : 22    SEQ ID NO:247
At_CesA3         : .V. .. . .... ..  D..  : 22    SEQ ID NO:248
BnaA03g55200D    : .V. .. . .... ..  D..  : 22    SEQ ID NO:248
BnaC03g02050D    : .V. .. . .... ..  D..  : 22    SEQ ID NO:248
BnaAnng01240D    : .V. .. . .... ..  D..  : 22    SEQ ID NO:248
BnaC02g02440D    : .V. .. . .... ..  D..  : 22    SEQ ID NO:248
Glyma09g15620    : .V. I. . .... ..  D..  : 22    SEQ ID NO:249
Glyma15g43040    : .V. I. . .... ..  D..  : 22    SEQ ID NO:249
Glyma12g36570    : .V. .. . .... ..  D..  : 22    SEQ ID NO:250
Glyma13g27250    : .V. I. . .... ..  D..  : 22    SEQ ID NO:249
Ha_Cesa3         : .V. I. . .... ..  D..  : 22    SEQ ID NO:249
GRMZM2G018241    : .V. AI. . .... ..  D.. : 22    SEQ ID NO:251
GRMZM2G424832    : .V. AI. . .... ..  D.. : 22    SEQ ID NO:251
Os07g10770.1     : .V. AI. . .... ..  D.. : 22    SEQ ID NO:251
GRMZM2G150404    : .V. AI. . .... ..  D.. : 22    SEQ ID NO:251
GRMZM2G111642    : .V. AI. . .... .M  D.. : 22    SEQ ID NO:252
Os03g59340.1     : .V. AI. . .... ..  D.. : 22    SEQ ID NO:251
At_CesA2         : IV. .I. . ..LT .. V..  : 22    SEQ ID NO:252
At_CesA9         : IL. .I. . ..LT .. V..  : 22    SEQ ID NO:253
At_CesA5         : IL. .I. . ..LT .. V..  : 22    SEQ ID NO:253
At_CesA6         : IV. .I. . ..LT .. V..  : 22    SEQ ID NO:252
BnaA02g34360D    : IV. .I. . ..LT .. V..  : 22    SEQ ID NO:252
BnaC02g43280D    : IV. .I. . ..LT .. V..  : 22    SEQ ID NO:252
BnaA06g23700D    : I.. .I.I . ..LT .. V.. : 22    SEQ ID NO:254
BnaC03g49550D    : IV. .I. . ..LT .. V..  : 22    SEQ ID NO:252
BnaA09g06990D    : IV. .I. . ..LT .. V..  : 22    SEQ ID NO:252
BnaC09g06600D    : IV. .I. . ..LT .. V..  : 22    SEQ ID NO:252
Glyma05g32100    : IL. .I. . ..LT M.  ...  : 22    SEQ ID NO:255
Glyma08g15380    : IL. .I. . ..LT M.  ...  : 22    SEQ ID NO:255
Glyma02g08920    : IL. AI. S ..LT ..  ...  : 22    SEQ ID NO:256
Glyma16g28080    : IL. AI. . ..LT ..  ...  : 22    SEQ ID NO:257
Glyma10g36790    : IL. AI. . .... ..  ...  : 22    SEQ ID NO:258
GRMZM2G025231    : ... I. . .... ..  D..  : 22    SEQ ID NO:244
GRMZM2G028353    : ... I. . .... ..  D..  : 22    SEQ ID NO:244
GRMZM2G113137    : ... I. . .... ..  D..  : 22    SEQ ID NO:244
Os03g62090.1     : ... I. . .... ..  D..  : 22    SEQ ID NO:244
Os07g24190.1     : ... I. . .... ..  D..  : 22    SEQ ID NO:244
Os07g24190.3     : ... I. . .... ..  D..  : 22    SEQ ID NO:244
GRMZM2G177631    : ... I. . .... ..  VD.  : 22    SEQ ID NO:259
Os07g14850.1     : ... I. . .... ..  D..  : 22    SEQ ID NO:244
Os07g24190.2     : ... I. . .... ..  D..  : 22    SEQ ID NO:244
Glyma06g47420    : .L. AI. . ..F. V. K D.. : 22    SEQ ID NO:260
```

Figure 2G

| | | | | |
|---|---|---|---|---|
| At_CesA1 | : | E LL HC IWYGYH PL | : 18 | SEQ ID NO:125 |
| BnaA01g04600D | : | ....... T . | : 18 | SEQ ID NO:261 |
| BnaC01g06090D | : | ....... T . | : 18 | SEQ ID NO:261 |
| BnaA03g52020D | : | ....... T . | : 18 | SEQ ID NO:261 |
| BnaC07g43790D | : | ....... T . | : 18 | SEQ ID NO:261 |
| Glyma04g07230 | : | .F..... L ...N K | : 18 | SEQ ID NO:262 |
| Glyma06g07320 | : | .F..... L ...N K | : 18 | SEQ ID NO:262 |
| Ha_Cesa1 | : | ....... ...N K | : 18 | SEQ ID NO:285 |
| At_CesA10 | : | ....... ...N . | : 18 | SEQ ID NO:263 |
| GRMZM2G027723 | : | ....... ...N . | : 18 | SEQ ID NO:263 |
| GRMZM2G112336 | : | ....... ...N . | : 18 | SEQ ID NO:263 |
| Os05g08370.1 | : | ....... ...N . | : 18 | SEQ ID NO:263 |
| GRMZM2G039454 | : | ....... ...N . | : 18 | SEQ ID NO:263 |
| At_CesA3 | : | ...F... ...M . | : 18 | SEQ ID NO:264 |
| BnaA03g55200D | : | ...F... ...S . | : 18 | SEQ ID NO:265 |
| BnaC03g02050D | : | ...F... ...S . | : 18 | SEQ ID NO:265 |
| BnaAnng01240D | : | ...F... ...S . | : 18 | SEQ ID NO:265 |
| BnaC02g02440D | : | ...F... ...S . | : 18 | SEQ ID NO:265 |
| Glyma09g15620 | : | ...F... ...S . | : 18 | SEQ ID NO:265 |
| Glyma15g43040 | : | ...F... ...S . | : 18 | SEQ ID NO:265 |
| Glyma12g36570 | : | ...F... ...G . | : 18 | SEQ ID NO:266 |
| Glyma13g27250 | : | ...F... ...G . | : 18 | SEQ ID NO:266 |
| Ha_Cesa3 | : | ...F... ...S . | : 18 | SEQ ID NO:265 |
| GRMZM2G018241 | : | ...F... L ..G . | : 18 | SEQ ID NO:267 |
| GRMZM2G424832 | : | ...F... L ..G . | : 18 | SEQ ID NO:267 |
| Os07g10770.1 | : | ...F... ...G . | : 18 | SEQ ID NO:266 |
| GRMZM2G150404 | : | ...F... L ..G . | : 18 | SEQ ID NO:267 |
| GRMZM2G111642 | : | ...F... ...G . | : 18 | SEQ ID NO:266 |
| Os03g59340.1 | : | ...F... ...G . | : 18 | SEQ ID NO:266 |
| At_CesA2 | : | ..F.... ...G G | : 18 | SEQ ID NO:268 |
| At_CesA9 | : | ..F.... ...G G | : 18 | SEQ ID NO:268 |
| At_CesA5 | : | ..F.... ...G G | : 18 | SEQ ID NO:268 |
| At_CesA6 | : | ..F.... ...G G | : 18 | SEQ ID NO:268 |
| BnaA02g34360D | : | ..F.... ...G G | : 18 | SEQ ID NO:268 |
| BnaC02g43280D | : | ..F.... ...G G | : 18 | SEQ ID NO:268 |
| BnaA06g23700D | : | ..F.... ...G G | : 18 | SEQ ID NO:268 |
| BnaC03g49550D | : | ..F.... ...G G | : 18 | SEQ ID NO:268 |
| BnaA09g06990D | : | ..F.... ...G G | : 18 | SEQ ID NO:268 |
| BnaC09g06600D | : | ..F.... ...G G | : 18 | SEQ ID NO:268 |
| Glyma05g32100 | : | ..FF... ...G G | : 18 | SEQ ID NO:269 |
| Glyma08g15380 | : | ..FF... ...G G | : 18 | SEQ ID NO:269 |
| Glyma02g08920 | : | ..FF... ...G G | : 18 | SEQ ID NO:269 |
| Glyma16g28080 | : | ..FF... ...G G | : 18 | SEQ ID NO:269 |
| Glyma10g36790 | : | ...K... ..GCG | : 18 | SEQ ID NO:270 |
| GRMZM2G025231 | : | .FF N.. L ..G G | : 18 | SEQ ID NO:271 |
| GRMZM2G028353 | : | .FF N.. L ..G G | : 18 | SEQ ID NO:271 |
| GRMZM2G113137 | : | .FF N.. L ..G G | : 18 | SEQ ID NO:271 |
| Os03g62090.1 | : | .FF N.. L ..G G | : 18 | SEQ ID NO:271 |
| Os07g24190.1 | : | .FF N.. L ..G G | : 18 | SEQ ID NO:271 |
| Os07g24190.3 | : | .FF N.. L ..G G | : 18 | SEQ ID NO:271 |
| GRMZM2G177631 | : | .FF K.. L ..G G | : 18 | SEQ ID NO:272 |
| Os07g14850.1 | : | .FF K.. L ..G G | : 18 | SEQ ID NO:272 |
| Os07g24190.2 | : | .FF N.. L ..G G | : 18 | SEQ ID NO:271 |
| Glyma06g47420 | : | .FM K.. L ..G G | : 18 | SEQ ID NO:273 |
| Ha_Cesa3b_fragm | : | ...F... ...S . | : 18 | SEQ ID NO:265 |
| Ha_Cesa6_fragme | : | ....... ..GCG | : 18 | SEQ ID NO:274 |

Figure 2H

| Name | | | SEQ ID |
|---|---|---|---|
| At_CesA1 | : | : 14 | SEQ ID NO:120 |
| BnaA01g04600D | : | : 14 | SEQ ID NO:120 |
| BnaC01g06090D | : | : 14 | SEQ ID NO:120 |
| BnaA03g52020D | : | : 14 | SEQ ID NO:120 |
| BnaC07g43790D | : | : 14 | SEQ ID NO:120 |
| Glyma04g07320 | : | : 14 | SEQ ID NO:275 |
| Glyma06g07320 | : | : 14 | SEQ ID NO:275 |
| Ha_Cesa1 | : | : 14 | SEQ ID NO:120 |
| At_CesA10 | : | : 14 | SEQ ID NO:276 |
| GRMZM2G027723 | : | : 14 | SEQ ID NO:275 |
| GRMZM2G112336 | : | : 14 | SEQ ID NO:275 |
| Os05g08370.1 | : | : 14 | SEQ ID NO:275 |
| GRMZM2G039454 | : | : 14 | SEQ ID NO:277 |
| At_CesA3 | : | : 14 | SEQ ID NO:278 |
| BnaA03g55200D | : | : 14 | SEQ ID NO:278 |
| BnaC03g02050D | : | : 14 | SEQ ID NO:278 |
| BnaAnng01240D | : | : 14 | SEQ ID NO:278 |
| BnaC02g02440D | : | : 14 | SEQ ID NO:278 |
| Glyma09g15620 | : | : 14 | SEQ ID NO:278 |
| Glyma15g43040 | : | : 14 | SEQ ID NO:278 |
| Glyma12g36570 | : | : 14 | SEQ ID NO:278 |
| Glyma13g27250 | : | : 14 | SEQ ID NO:278 |
| Ha_Cesa3 | : | : 14 | SEQ ID NO:278 |
| GRMZM2G018241 | : | : 14 | SEQ ID NO:279 |
| GRMZM2G424832 | : | : 14 | SEQ ID NO:279 |
| Os07g10770.1 | : | : 14 | SEQ ID NO:279 |
| GRMZM2G150404 | : | : 14 | SEQ ID NO:279 |
| GRMZM2G111642 | : | : 14 | SEQ ID NO:279 |
| Os03g59340.1 | : | : 14 | SEQ ID NO:279 |
| At_CesA2 | : | : 14 | SEQ ID NO:278 |
| At_CesA9 | : | : 14 | SEQ ID NO:280 |
| At_CesA5 | : | : 14 | SEQ ID NO:280 |
| At_CesA6 | : | : 14 | SEQ ID NO:281 |
| BnaA02g34360D | : | : 14 | SEQ ID NO:280 |
| BnaC02g43280D | : | : 14 | SEQ ID NO:280 |
| BnaA06g23700D | : | : 14 | SEQ ID NO:280 |
| BnaC03g49550D | : | : 14 | SEQ ID NO:280 |
| BnaA09g06990D | : | : 14 | SEQ ID NO:280 |
| BnaC09g06600D | : | : 14 | SEQ ID NO:280 |
| Glyma05g32100 | : | : 14 | SEQ ID NO:281 |
| Glyma08g15380 | : | : 14 | SEQ ID NO:281 |
| Glyma02g08920 | : | : 14 | SEQ ID NO:282 |
| Glyma16g28080 | : | : 14 | SEQ ID NO:282 |
| Glyma10g36790 | : | : 14 | SEQ ID NO:282 |
| GRMZM2G025231 | : | : 14 | SEQ ID NO:278 |
| GRMZM2G028353 | : | : 14 | SEQ ID NO:278 |
| GRMZM2G113137 | : | : 14 | SEQ ID NO:278 |
| Os03g62090.1 | : | : 14 | SEQ ID NO:278 |
| Os07g24190.1 | : | : 14 | SEQ ID NO:278 |
| Os07g24190.3 | : | : 14 | SEQ ID NO:278 |
| GRMZM2G177631 | : | : 14 | SEQ ID NO:278 |
| Os07g14850.1 | : | : 14 | SEQ ID NO:278 |
| Os07g24190.2 | : | : 14 | SEQ ID NO:278 |
| Glyma06g47420 | : | : 14 | SEQ ID NO:283 |
| Ha_Cesa6_fragme | : | : 9 | SEQ ID NO:284 |

Figure 3 A
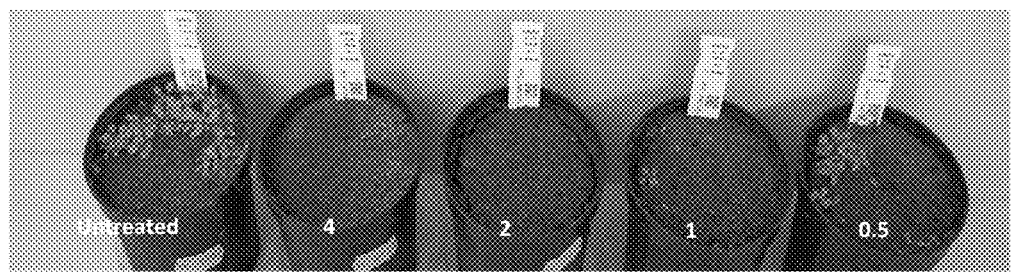
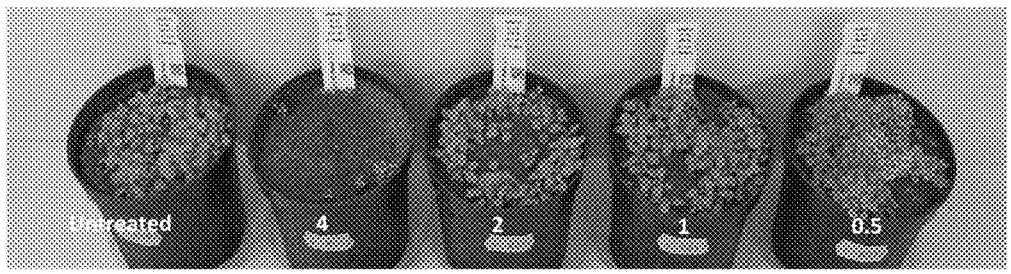

Figure 3 B
1
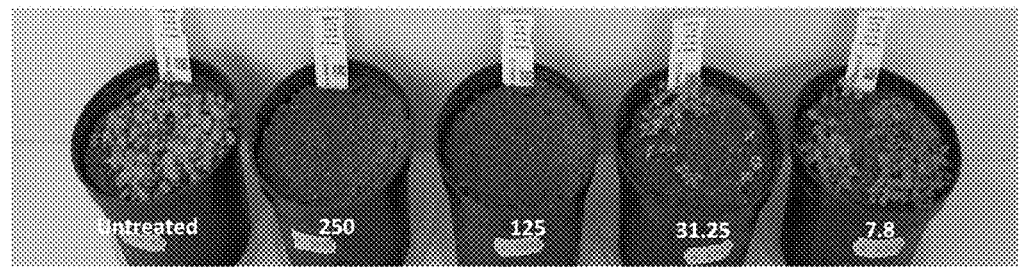
2

PLANTS HAVING INCREASED TOLERANCE TO HERBICIDES

CROSS-REFERENCE TO RELATED APPLICATIONS

This application is a continuation of U.S. patent application Ser. No. 15/769,973, which is a U.S. National Stage application of International Application No. PCT/162016/056349, filed Oct. 21, 2016, which claims priority to European Patent Application No. 15190978.5, filed on Oct. 22, 2015; the aforementioned applications are hereby incorporated by reference herein in their entireties.

INCORPORATION BY REFERENCE OF MATERIAL SUBMITTED ELECTRONICALLY

The Sequence Listing, which is a part of the present disclosure, is submitted concurrently with the specification as a text file. The name of the text file containing the Sequence Listing is "150053A_Seqlisting.txt", which was created on Jul. 21, 2021 and is 874,990 bytes in size. The subject matter of the Sequence Listing is incorporated herein in its entirety by reference.

FIELD OF THE INVENTION

The present invention relates in general to methods for conferring on plants agricultural level tolerance to herbicides. Particularly, the invention refers to plants having an increased tolerance to herbicides, more specifically to herbicides which inhibit the enzyme cellulose synthase (CESA), also known cellulose biosynthesis inhibitors (CBI). More specifically, the present invention relates to methods and plants obtained by mutagenesis and cross-breeding and transformation that have an increased tolerance to herbicides, particularly CESA-inhibiting herbicides.

BACKGROUND OF THE INVENTION

Plant cell walls are complex structures composed of high-molecular-weight polysaccharides, proteins, and lignins. Among the wall polysaccharides, cellulose, a hydrogen-bonded β-1,4-linked glucan microfibril, is the main load-bearing wall component and a key precursor for industrial applications. Cellulose is synthesized by large multimeric cellulose synthase (CESA) complexes (E.C.2.4.1.12), tracking along cortical microtubules at the plasma membrane. The only known components of these complexes are the cellulose synthase proteins. Recent studies have identified tentative interaction partners for the CESAs and shown that the migratory patterns of the CESA complexes depend on phosphorylation status (for review see Endler and Persson, Molecular Plant, 2011, Volume 4, Number 2, Pages 199-211, and references contained therein). For example, cotton cellulose synthase genes, termed CESA1 and CESA2, were identified in a collection of expressed sequence tag (EST) sequences on the basis of weak sequence similarity to genes for cellulose synthase from bacteria (Richmond and Somerville. Plant Physiology, 2000, Vol. 124, 495-498; and references contained therein) In addition, the genes were expressed at high levels in cotton fibers at the onset of secondary wall synthesis and a purified fragment of one of the corresponding proteins as shown to bind UDP-Glc, the proposed substrate for cellulose biosynthesis. The conclusion that the cotton CESA genes are cellulose synthases is supported by results obtained with two cellulose-deficient Arabidopsis mutants, rsw1 and irx3 (Richmond and Somerville. Plant Physiology, Vol. 124, 2000, 495-498; and references contained therein). The genes corresponding to the RSW1 and IRX3 loci exhibit a high degree of sequence similarity to the cotton CESA genes and are considered orthologs. Ten full-length CESA genes have been sequenced from Arabidopsis, and there is a genome survey sequence that may indicate one additional family member. Reiterative database searches using the Arabidopsis Rsw1 (AtCESA1) and the cotton CESA polypeptide sequences as the initial query sequences revealed a large superfamily of at least 41 CESA-like genes in Arabidopsis. Based on predicted protein sequences, these genes were grouped into seven clearly distinguishable families (Richmond and Somerville. Plant Physiology, Vol. 124, 2000, 495-498; and references contained therein): the CESA family, which includes RSW1 and IRX3 (AtCESA7), and six families of structurally related genes of unknown function designated as the "cellulose synthase-like" genes (CslA, CslB, CslC, CslD, CslE, and CslG).

WO 2013/142968 describes plant cellulose synthase (CESA) alleles identified by mutagenizing plants and screening said plants with a cellulose biosynthetic inhibitor (CBI). CBIs employed in WO 2013/142968 include dichlobenil, chlorthiamid, isoxaben, flupoxam, and quinclorac, particularly isoxaben or flupoxam (named fpx1-1 to fxp1-3 [CESA3], fxp2-1 to fxp2-3 [CESA1] and ixr1-1 to ixr1-7 [CESA3], ixr2-1 to ixr2-2 [CESA6] mutants of Arabidopsis CESA wildtype enzymes)

The inventors of the present invention have now surprisingly found that over-expression of new mutant cellulose synthase forms which were not disclosed in WO 2013/142968 confers in plants tolerance/resistance to particular classes of CESA-inhibiting herbicides (cellulose biosynthesis inhibitors; CBIs) as compared to the non-transformed and/or non-mutagenized plants or plant cells, respectively. More specifically, the inventors of the present invention have found that CESA expression confers tolerance/resistance to azines. More specifically, the inventors of the present invention have found that modifications of the N-terminal and or the C-terminal part of CESA proteins confer tolerance/resistance to azines.

The problem of the present invention can be seen as to the provision of novel traits by identifying target polypeptides, the manipulation of which makes plants tolerant to herbicides.

Three main strategies are available for making plants tolerant to herbicides, i.e. (1) detoxifying the herbicide with an enzyme which transforms the herbicide, or its active metabolite, into non-toxic products, such as, for example, the enzymes for tolerance to bromoxynil or to Basta (EP242236, EP337899); (2) mutating the target enzyme into a functional enzyme which is less sensitive to the herbicide, or to its active metabolite, such as, for example, the enzymes for tolerance to glyphosate (EP293356, Padgette S. R. et al., J. Biol. Chem., 266, 33, 1991); or (3) overexpressing the sensitive enzyme so as to produce quantities of the target enzyme in the plant which are sufficient in relation to the herbicide, in view of the kinetic constants of this enzyme, so as to have enough of the functional enzyme available despite the presence of its inhibitor.

The problem is solved by the subject-matter of the present invention.

SUMMARY OF THE INVENTION

Accordingly, in one aspect, the present invention provides a plant or plant part comprising a polynucleotide encoding a mutated CESA polypeptide, the expression of said polynucleotide confers to the plant or plant part tolerance to CESA-inhibiting herbicides.

In some aspects, the present invention provides a seed capable of germination into a plant comprising in at least some of its cells a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides.

In one aspect, the present invention provides a plant cell of or capable of regenerating a plant comprising in at least some of its cells a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides, wherein the plant cell comprises the polynucleotide operably linked to a promoter.

In another aspect, the present invention provides a plant cell comprising a polynucleotide operably linked to a promoter operable in a cell, the promoter capable of expressing a mutated CESA polypeptide encoded by the polynucleotide, the expression of the mutated CESA polypeptide conferring to the plant tolerance to CESA-inhibiting herbicides.

In other aspects, the present invention provides a plant product prepared from a plant or plant part comprising in at least some of its cells a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides.

In some aspects, the present invention provides a progeny or descendant plant derived from a plant comprising in at least some of its cells a polynucleotide operably linked to a promoter operable in plant cells, the promoter capable of expressing a mutated CESA polypeptide encoded by the polynucleotide, wherein the progeny or descendant plant comprises in at least some of its cells the recombinant polynucleotide operably linked to the promoter, the expression of the mutated CESA polypeptide conferring to the progeny or descendant plant tolerance to the CESA-inhibiting herbicides.

In other aspects, the present invention provides a method for controlling weeds at a locus for growth of a plant, the method comprising: (a) applying an herbicide composition comprising CESA-inhibiting herbicides to the locus; and (b) planting a seed at the locus, wherein the seed is capable of producing a plant that comprises in at least some of its cells a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides.

In some aspects, the present invention provides a method for controlling weeds at a locus for growth of a plant, the method comprising: applying an herbicidal composition comprising CESA-inhibiting herbicides to the locus; wherein said locus is: (a) a locus that contains: a plant or a seed capable of producing said plant; or (b) a locus that is to be after said applying is made to contain the plant or the seed; wherein the plant or the seed comprises in at least some of its cells a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides.

In one aspect, step (a) occurs before, after, or concurrently with step (b).

In other aspects, the present invention provides a method of producing a plant having tolerance to CESA-inhibiting herbicides, the method comprising regenerating a plant from a plant cell transformed with a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides.

In one aspect, the present invention provides a method of producing a progeny plant having tolerance to CESA-inhibiting herbicides, the method comprising: crossing a first CESA-inhibiting herbicides-tolerant plant with a second plant to produce a CESA-inhibiting herbicides-tolerant progeny plant, wherein the first plant and the progeny plant comprise in at least some of their cells a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides.

In addition, the present invention refers to a method for identifying a CESA-inhibiting herbicide by using a mutated CESA of the present invention encoded by a nucleic acid which comprises the nucleotide sequence of SEQ ID NO: 84, 85, 86, 87, 88, 89, 90, 91, 92, 93, 94, 95, 96, 97, or 98, or a variant, homologue, paralogue or orthologue thereof.

Said method comprises the steps of:
a) generating a transgenic cell or plant comprising a nucleic acid encoding a mutated CESA of the present invention, wherein the mutated CESA of the present invention is expressed;
b) applying a CESA-inhibiting herbicide to the transgenic cell or plant of a) and to a control cell or plant of the same variety;
c) determining the growth or the viability of the transgenic cell or plant and the control cell or plant after application of said test compound, and
d) selecting test compounds which confer reduced growth to the control cell or plant as compared to the growth of the transgenic cell or plant.

Another object refers to a method of identifying a nucleotide sequence encoding a mutated CESA which is resistant or tolerant to a CESA-inhibiting herbicide, the method comprising:
a) generating a library of mutated CESA-encoding nucleic acids,
b) screening a population of the resulting mutated CESA-encoding nucleic acids by expressing each of said nucleic acids in a cell or plant and treating said cell or plant with a CESA-inhibiting herbicide,
c) comparing the CESA-inhibiting herbicide-tolerance levels provided by said population of mutated CESA encoding nucleic acids with the CESA-inhibiting herbicide-tolerance level provided by a control CESA-encoding nucleic acid,
d) selecting at least one mutated CESA-encoding nucleic acid that provides a significantly increased level of tolerance to a CESA-inhibiting herbicide as compared to that provided by the control CESA-encoding nucleic acid.

In a preferred embodiment, the mutated CESA-encoding nucleic acid selected in step d) provides at least 2-fold as much tolerance to a CESA-inhibiting herbicide as compared to that provided by the control CESA-encoding nucleic acid.

The resistance or tolerance can be determined by generating a transgenic plant comprising a nucleic acid sequence of the library of step a) and comparing said transgenic plant with a control plant.

Another object refers to a method of identifying a plant or algae containing a nucleic acid encoding a mutated CESA which is resistant or tolerant to a CESA-inhibiting herbicide, the method comprising:
  a) identifying an effective amount of a CESA-inhibiting herbicide in a culture of plant cells or green algae.
  b) treating said plant cells or green algae with a mutagenizing agent,
  c) contacting said mutagenized cells population with an effective amount of CESA-inhibiting herbicide, identified in a),
  d) selecting at least one cell surviving these test conditions,
  e) PCR-amplification and sequencing of CESA genes from cells selected in d) and comparing such sequences to wild-type CESA gene sequences, respectively.

In a preferred embodiment, the mutagenizing agent is ethylmethanesulfonate.

Another object refers to an isolated recombinantly produced, and/or chemically synthesized nucleic acid encoding a mutated CESA, the nucleic acid comprising the sequence of SEQ ID NO: 84, 85, 86, 87, 88, 89, 90, 91, 92, 93, 94, 95, 96, 97, or 98, or a variant thereof, as defined hereinafter.

In a preferred embodiment, the nucleic acid being identifiable by a method as defined above.

Another object refers to an isolated, recombinantly produced, and/or chemically synthesized mutated CESA polypeptide, the polypeptide comprising the sequence set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, a variant, derivative, orthologue, paralogue or homologue thereof, as defined hereinafter.

In still further aspects, the present invention provides a plant or plant part comprising in at least some of its cells a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides, wherein the plant or plant part further exhibits a second or third herbicide-tolerant trait.

In another embodiment, the invention refers to a plant cell transformed by and expressing a a mutated CESA nucleic acid according to the present invention or a plant which has been mutated to obtain a plant expressing, preferably overexpressing a mutated CESA nucleic acid according to the present invention, wherein expression of said nucleic acid in the plant cell results in increased resistance or tolerance to a CESA-inhibiting herbicide as compared to a wild type variety of the plant cell In another embodiment, the invention refers to a plant comprising a plant cell according to the present invention, wherein expression of the mutated CESA nucleic acid in the plant results in the plant's increased resistance to CESA-inhibiting herbicide as compared to a wild type variety of the plant.

The plants of the present invention can be transgenic or non-transgenic.

Preferably, the expression of the nucleic acid of the invention in the plant results in the plant's increased resistance to CESA-inhibiting herbicides as compared to a wild type variety of the plant. In another embodiment, the invention refers to a seed produced by a transgenic plant comprising a plant cell of the present invention, wherein the seed is true breeding for an increased resistance to a CESA-inhibiting herbicide as compared to a wild type variety of the seed.

In another embodiment, the invention refers to a method of producing a transgenic plant cell with an increased resistance to a CESA-inhibiting herbicide as compared to a wild type variety of the plant cell comprising, transforming the plant cell with an expression cassette comprising a polynucleotide operably linked to a promoter operable in plant cells, the promoter capable of expressing a mutated CESA polypeptide encoded by the polynucleotide.

In another embodiment, the invention refers to a method of producing a transgenic plant comprising, (a) transforming a plant cell with an expression cassette comprising a polynucleotide operably linked to a promoter operable in plant cells, the promoter capable of expressing a mutated CESA polypeptide encoded by the polynucleotide, and (b) generating a plant with an increased resistance to CESA-inhibiting herbicide from the plant cell.

Preferably, the expression cassette further comprises a transcription initiation regulatory region and a translation initiation regulatory region that are functional in the plant.

BRIEF DESCRIPTION OF THE DRAWINGS

FIG. 1A shows phylogenetic trees of cellulose synthase homologues in corn, FIG. 1B shows phylogenetic trees of cellulose synthase homologues in soy, FIG. 1C shows phylogenetic trees of cellulose synthase homologues in rice, FIG. 1D shows phylogenetic trees of cellulose synthase homologues in *Brassica napus* and FIG. 1E shows phylogenetic trees of cellulose synthase homologues in *Helianthus annuus*.

FIG. 2A, FIG. 2B, FIG. 2C, FIG. 2D, FIG. 2E, FIG. 2F, FIG. 2G, FIG. 2H

FIGS. 2A-H show amino acid alignments of eight identified regions in primary cellulose synthase proteins regions that cause tolerance to azine-herbicides once (indicated amounts [g ai/ha] of 1-[4-chloro-3-(2,2,3,3,3-pentafluoropropoxymethyl)phenyl]-5-phenyl-1,2,4-triazole-3-carboxamide).
1: wildtype
2: SEQ ID NO: 1 Variant: R292H

KEY TO SEQUENCE LISTING

TABLE 1

Figure 1A:
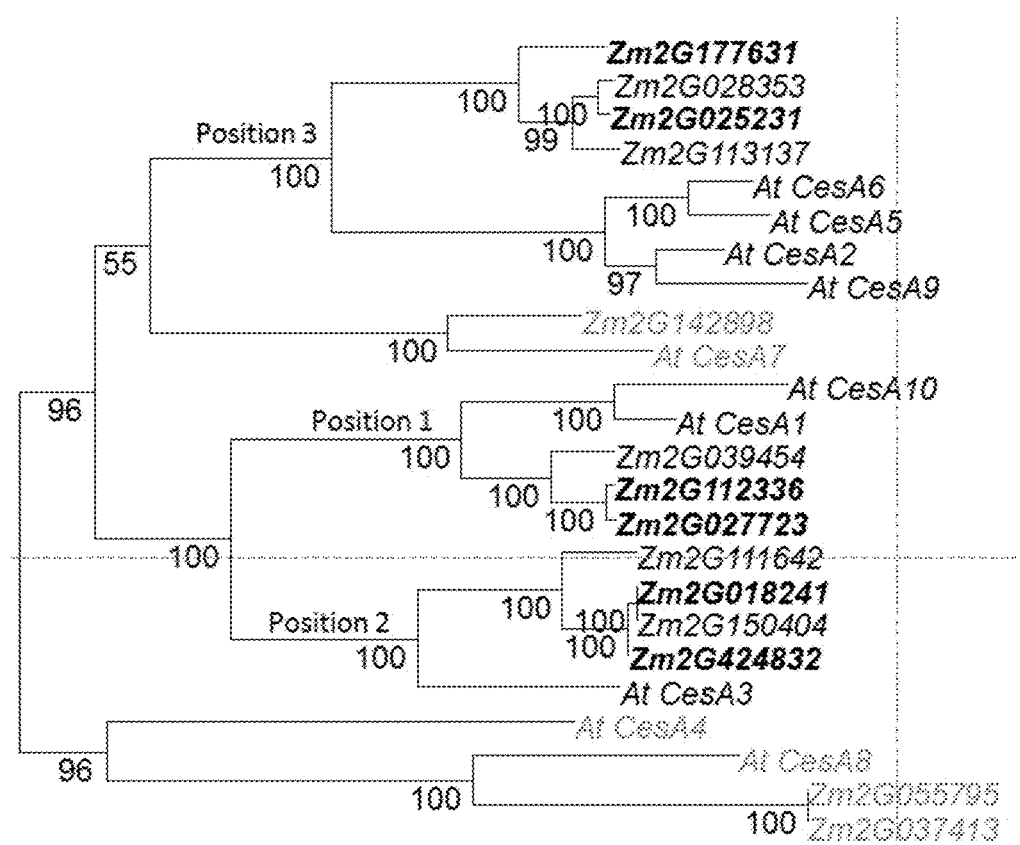
FIG. 1A, FIG. 1B, FIG. 1C, FIG. 1D, and FIG. 1E

| SEQ ID NO Amino acid | Sequence/Origin |
|---|---|
| 1 | At_CESA1 |
| 2 | At_CESA2 |
| 3 | At_CESA3 |
| 4 | At_CESA4 |
| 5 | At_CESA5 |
| 6 | At_CESA6 |
| 7 | At_CESA7 |
| 8 | At_CESA8 |
| 9 | At_CESA9 |
| 10 | At_CESA10 |
| 11 | GRMZM2G027723\|GRMZM2G027723_T01 |
| 12 | GRMZM2G055795\|GRMZM2G055795_T01 |
| 13 | GRMZM2G039454\|GRMZM2G039454_T01 |
| 14 | GRMZM2G025231\|GRMZM2G025231_T02 |
| 15 | GRMZM2G142898\|GRMZM2G142898_T01 |
| 16 | GRMZM2G424832\|GRMZM2G424832_T01 |
| 17 | GRMZM2G177631\|GRMZM2G177631_T01 |
| 18 | GRMZM2G150404\|GRMZM2G150404_T01 |
| 19 | GRMZM2G028353\|GRMZM2G028353_T01 |
| 20 | GRMZM2G018241\|GRMZM2G018241_T01 |
| 21 | GRMZM2G037413\|GRMZM2G037413_T01 |
| 22 | GRMZM2G082580\|GRMZM2G082580_T01 |
| 23 | GRMZM2G112336\|GRMZM2G112336_T01 |
| 24 | GRMZM2G111642\|GRMZM2G111642_T01 |
| 25 | GRMZM2G113137\|GRMZM2G113137_T01 |
| 26 | Glyma02g36720\|Glyma02g36720.1 |
| 27 | Glyma02g08920\|Glyma02g08920.1 |
| 28 | Glyma12g36570\|Glyma12g36570.1 |
| 29 | Glyma12g17730\|Glyma12g17730.1 |
| 30 | Glyma06g06870\|Glyma06g06870.1 |
| 31 | Glyma06g30860\|Glyma06g30860.1 |
| 32 | Glyma06g47420\|Glyma06g47420.1 |
| 33 | Glyma06g30850\|Glyma06g30850.1 |
| 34 | Glyma06g07320\|Glyma06g07320.1 |
| 35 | Glyma04g07220\|Glyma04g07220.1 |
| 36 | Glyma04g06780\|Glyma04g06780.1 |
| 37 | Glyma04g23530\|Glyma04g23530.2 |
| 38 | Glyma08g15380\|Glyma08g15380.1 |
| 39 | Glyma08g12400\|Glyma08g12400.1 |
| 40 | Glyma17g08000\|Glyma17g08000.1 |
| 41 | Glyma13g27250\|Glyma13g27250.3 |
| 42 | Glyma05g29240\|Glyma05g29240.2 |
| 43 | Glyma05g32100\|Glyma05g32100.1 |
| 44 | Glyma15g43040\|Glyma15g43040.1 |
| 45 | Glyma09g15620\|Glyma09g15620.2 |
| 46 | Glyma10g36790\|Glyma10g36790.1 |
| 47 | Glyma16g28080\|Glyma16g28080.2 |
| 48 | Os01g54620.1 |
| 49 | Os03g59340.1 |
| 50 | Os03g62090.1 |
| 51 | Os05g08370.1 |
| 52 | Os06g02180.1 |
| 53 | Os06g22980.1 |
| 54 | Os06g39970.1 |
| 55 | Os07g10770.1 |
| 56 | Os07g14850.1 |
| 57 | Os07g24190.1 |
| 58 | Os07g24190.2 |
| 59 | Os07g24190.3 |
| 60 | Os08g25710.1 |
| 61 | Os09g25490.1 |
| 62 | Os10g32980.1 |
| 63 | Os10g42750.1 |
| 64 | Os12g36890.1 |
| 65 | BnaA06g23700D |
| 66 | BnaA03g55200D |

TABLE 1-continued

| SEQ ID NO Amino acid | Sequence/Origin |
|---|---|
| 67 | BnaA09g06990D |
| 68 | BnaA02g34360D |
| 69 | BnaA03g52020D |
| 70 | BnaC02g02440D |
| 71 | BnaC03g49550D |
| 72 | BnaC02g43280D |
| 73 | BnaC07g43790D |
| 74 | BnaAnng01240D |
| 75 | BnaA01g04600D |
| 76 | BnaC01g06090D |
| 77 | BnaC03g02050D |
| 78 | BnaC09g06600D |
| 79 | Ha_Cesa1 |
| 80 | Ha_Cesa3 |
| 81 | Ha_Cesa7 |
| 82 | Ha_Cesa3b_fragment |
| 83 | Ha_Cesa6_fragment |

DETAILED DESCRIPTION

The articles "a" and "an" are used herein to refer to one or more than one (i.e., to at least one) of the grammatical object of the article. By way of example, "an element" means one or more elements.

As used herein, the word "comprising," or variations such as "comprises" or "comprising," will be understood to imply the inclusion of a stated element, integer or step, or group of elements, integers or steps, but not the exclusion of any other element, integer or step, or group of elements, integers or steps.

The term "control of undesired vegetation or weeds" is to be understood as meaning the killing of weeds and/or otherwise retarding or inhibiting the normal growth of the weeds. Weeds, in the broadest sense, are understood as meaning all those plants which grow in locations where they are undesired. The weeds of the present invention include, for example, dicotyledonous and monocotyledonous weeds. Dicotyledonous weeds include, but are not limited to, weeds of the genera: *Sinapis, Lepidium, Galium, Stellaria, Matricaria, Anthemis, Galinsoga, Chenopodium, Urtica, Senecio, Amaranthus, Portulaca, Xanthium, Convolvulus, Ipomoea, Polygonum, Sesbania, Ambrosia, Cirsium, Carduus, Sonchus, Solanum, Rorippa, Rotala, Lindernia, Lamium, Veronica, Abutilon, Emex, Datura, Viola, Galeopsis, Papaver, Centaurea, Trifolium, Ranunculus*, and *Taraxacum*. Monocotyledonous weeds include, but are not limited to, weeds of the genera: *Echinochloa, Setaria, Panicum, Digitaria, Phleum, Poa, Festuca, Eleusine, Brachiaria, Lolium, Bromus, Avena, Cyperus, Sorghum, Agropyron, Cynodon, Monochoria, Fimbristylis, Sagittaria, Eleocharis, Scirpus, Paspalum, Ischaemum, Sphenoclea, Dactyloctenium, Agrostis, Alopecurus*, and *Apera*. In addition, the weeds of the present invention can include, for example, crop plants that are growing in an undesired location. For example, a volunteer maize plant that is in a field that predominantly comprises soybean plants can be considered a weed, if the maize plant is undesired in the field of soybean plants.

The term "plant" is used in its broadest sense as it pertains to organic material and is intended to encompass eukaryotic organisms that are members of the Kingdom Plantae, examples of which include but are not limited to vascular plants, vegetables, grains, flowers, trees, herbs, bushes, grasses, vines, ferns, mosses, fungi and algae, etc, as well as clones, offsets, and parts of plants used for asexual propagation (e.g. cuttings, pipings, shoots, rhizomes, underground stems, clumps, crowns, bulbs, corms, tubers, rhizomes, plants/tissues produced in tissue culture, etc.). The term "plant" further encompasses whole plants, ancestors and progeny of the plants and plant parts, including seeds, shoots, stems, leaves, roots (including tubers), flowers, florets, fruits, pedicles, peduncles, stamen, anther, stigma, style, ovary, petal, sepal, carpel, root tip, root cap, root hair, leaf hair, seed hair, pollen grain, microspore, cotyledon, hypocotyl, epicotyl, xylem, phloem, parenchyma, endosperm, a companion cell, a guard cell, and any other known organs, tissues, and cells of a plant, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis* spp, *Artocarpus* spp., *Asparagus officinalis, Avena* spp. (e.g. *Avena sativa, Avena fatua, Avena byzantina, Avena fatua* var. *sativa, Avena hybrida*), *Averrhoa carambola, Bambusa* sp., *Benincasa hispida, Bertholletia excelsea, Beta vulgaris, Brassica* spp. (e.g. *Brassica napus, Brassica rapa* ssp. [canola, oilseed rape, turnip rape]), *Cadaba farinosa, Camellia sinensis, Canna indica, Cannabis sativa, Capsicum* spp., *Carex elata, Carica papaya, Carissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium* spp., *Dimocarpus longan, Dioscorea* spp., *Diospyros* spp., *Echinochloa* spp., *Elaeis* (e.g. *Elaeis guineensis, Elaeis oleifera*), *Eleusine coracana, Eragrostis tef, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja max*), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgatum, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amaranth, artichoke, asparagus, broccoli, Brussels sprouts, cabbage, canola, carrot, cauliflower, celery, collard greens, flax, kale, lentil, oilseed rape, okra, onion, potato, rice, soybean, strawberry, sugar beet, sugar cane, sunflower, tomato, squash, tea and algae, amongst others. According to a preferred embodiment of the present invention, the plant is a crop plant. Examples of crop plants include inter alia soybean, sunflower, canola, alfalfa, rapeseed, cotton, tomato, potato or tobacco. Further preferably, the plant is a monocotyledonous plant, such as sugarcane. Further preferably, the plant is a cereal, such as rice, maize, wheat, barley, millet, rye, sorghum or oats.

Generally, the term "herbicide" is used herein to mean an active ingredient that kills, controls or otherwise adversely modifies the growth of plants. The preferred amount or concentration of the herbicide is an "effective amount" or "effective concentration." By "effective amount" and "effective concentration" is intended an amount and concentration, respectively, that is sufficient to kill or inhibit the growth of a similar, wild-type, plant, plant tissue, plant cell, or host cell, but that said amount does not kill or inhibit as severely the growth of the herbicide-resistant plants, plant tissues, plant cells, and host cells of the present invention. Typically, the effective amount of a herbicide is an amount that is routinely used in agricultural production systems to kill weeds of interest. Such an amount is known to those of ordinary skill in the art. Herbicidal activity is exhibited by herbicides useful for the present invention when they are applied directly to the plant or to the locus of the plant at any stage of growth or before planting or emergence. The effect observed depends upon the plant species to be controlled, the stage of growth of the plant, the application parameters of dilution and spray drop size, the particle size of solid components, the environmental conditions at the time of use, the specific compound employed, the specific adjuvants and carriers employed, the soil type, and the like, as well as the amount of chemical applied. These and other factors can be adjusted as is known in the art to promote non-selective or selective herbicidal action. Generally, it is preferred to apply the herbicide postemergence to relatively immature undesirable vegetation to achieve the maximum control of weeds.

By a "herbicide-tolerant" or "herbicide-resistant" plant, it is intended that a plant that is tolerant or resistant to at least one herbicide at a level that would normally kill, or inhibit the growth of, a normal or wild-type plant. Levels of herbicide that normally inhibit growth of a non-tolerant plant are known and readily determined by those skilled in the art. Examples include the amounts recommended by manufacturers for application. The maximum rate is an example of an amount of herbicide that would normally inhibit growth of a non-tolerant plant. For the present invention, the terms "herbicide-tolerant" and "herbicide-resistant" are used interchangeably and are intended to have an equivalent meaning and an equivalent scope. Similarly, the terms "herbicide-tolerance" and "herbicide-resistance" are used interchangeably and are intended to have an equivalent meaning and an equivalent scope. Similarly, the terms "tolerant" and "resistant" are used interchangeably and are intended to have an equivalent meaning and an equivalent scope. As used herein, in regard to an herbicidal composition useful in various embodiments hereof, terms such as CESA-inhibiting herbicides, and the like, refer to those agronomically acceptable herbicide active ingredients (A.I.) recognized in the art. Similarly, terms such as fungicide, nematicide, pesticide, and the like, refer to other agronomically acceptable active ingredients recognized in the art.

When used in reference to a particular mutant enzyme or polypeptide, terms such as herbicide-tolerant and herbicide-tolerance refer to the ability of such enzyme or polypeptide to perform its physiological activity in the presence of an amount of an herbicide A.I. that would normally inactivate or inhibit the activity of the wild-type (non-mutant) version of said enzyme or polypeptide. For example, when used specifically in regard to a CESA enzyme, it refers specifically to the ability to tolerate a CESA-inhibitor. By "herbicide-tolerant mutated CESA protein" or "herbicide-resistant mutated CESA protein", it is intended that such a CESA protein displays higher CESA activity, relative to the CESA activity of a wild-type CESA protein, when in the presence of at least one herbicide that is known to interfere with CESA activity and at a concentration or level of the herbicide that is known to inhibit the CESA activity of the wild-type CESA protein. Furthermore, the CESA activity of such a herbicide-tolerant or herbicide-resistant mutated CESA protein may be referred to herein as "herbicide-tolerant" or "herbicide-resistant" CESA activity.

As used herein, "recombinant," when referring to nucleic acid or polypeptide, indicates that such material has been altered as a result of human application of a recombinant technique, such as by polynucleotide restriction and ligation, by polynucleotide overlap-extension, or by genomic insertion or transformation. A gene sequence open reading frame is recombinant if that nucleotide sequence has been removed from it natural text and cloned into any type of artificial nucleic acid vector. The term recombinant also can refer to an organism having a recombinant material, e.g., a plant that comprises a recombinant nucleic acid can be considered a recombinant plant.

The term "transgenic plant" refers to a plant that comprises a heterologous polynucleotide. Preferably, the heterologous polynucleotide is stably integrated within the genome such that the polynucleotide is passed on to successive generations. The heterologous polynucleotide may be integrated into the genome alone or as part of a recombinant expression cassette. "Transgenic" is used herein to refer to any cell, cell line, callus, tissue, plant part or plant, the genotype of which has been so altered by the presence of heterologous nucleic acid including those transgenic organisms or cells initially so altered, as well as those created by crosses or asexual propagation from the initial transgenic organism or cell. In some embodiments, a "recombinant" organism is a "transgenic" organism. The term "transgenic" as used herein is not intended to encompass the alteration of the genome (chromosomal or extra-chromosomal) by conventional plant breeding methods (e.g., crosses) or by naturally occurring events such as, e.g., self-fertilization, random cross-fertilization, non-recombinant viral infection, non-recombinant bacterial transformation, non-recombinant transposition, or spontaneous mutation.

As used herein, "mutagenized" refers to an organism or DNA thereof having alteration(s) in the biomolecular sequence of its native genetic material as compared to the sequence of the genetic material of a corresponding wild-type organism or DNA, wherein the alteration(s) in genetic material were induced and/or selected by human action. Examples of human action that can be used to produce a mutagenized organism or DNA include, but are not limited to, as illustrated in regard to herbicide tolerance: tissue culture of plant cells (e.g., calli) and selection thereof with herbicides (e.g., CESA-inhibiting herbicides), treatment of plant cells with a chemical mutagen such as EMS and subsequent selection with herbicide(s); or by treatment of plant cells with x-rays and subsequent selection with herbicide(s). Any method known in the art can be used to induce mutations. Methods of inducing mutations can induce mutations in random positions in the genetic material or can induce mutations in specific locations in the genetic material (i.e., can be directed mutagenesis techniques), such as by use of a genoplasty technique.

As used herein, a "genetically modified organism" (GMO) is an organism whose genetic characteristics contain alteration(s) that were produced by human effort causing transfection that results in transformation of a target organism with genetic material from another or "source" organism, or with synthetic or modified-native genetic material, or an organism that is a descendant thereof that retains the inserted genetic material. The source organism can be of a different type of organism (e.g., a GMO plant can contain bacterial genetic material) or from the same type of organism (e.g., a GMO plant can contain genetic material from another plant). As used herein in regard to plants and other organisms, "recombinant," "transgenic," and "GMO" are considered synonyms and indicate the presence of genetic material from a different source; in contrast, "mutagenized" is used to refer to a plant or other organism, or the DNA thereof, in which no such transgenic material is present, but in which the native genetic material has become mutated so as to differ from a corresponding wild-type organism or DNA.

As used herein, "wild-type" or "corresponding wild-type plant" means the typical form of an organism or its genetic material, as it normally occurs, as distinguished from, e.g., mutagenized and/or recombinant forms. Similarly, by "control cell" or "similar, wild-type, plant, plant tissue, plant cell or host cell" is intended a plant, plant tissue, plant cell, or host cell, respectively, that lacks the herbicide-resistance characteristics and/or particular polynucleotide of the invention that are disclosed herein. The use of the term "wild-type" is not, therefore, intended to imply that a plant, plant tissue, plant cell, or other host cell lacks recombinant DNA in its genome, and/or does not possess herbicide-resistant characteristics that are different from those disclosed herein.

As used herein, "descendant" refers to any generation plant. In some embodiments, a descendant is a first, second, third, fourth, fifth, sixth, seventh, eight, ninth, or tenth generation plant.

As used herein, "progeny" refers to a first generation plant.

The term "seed" comprises seeds of all types, such as, for example, true seeds, caryopses, achenes, fruits, tubers, seedlings and similar forms. In the context of *Brassica* and *Sinapis* species, "seed" refers to true seed(s) unless otherwise specified. For example, the seed can be seed of transgenic plants or plants obtained by traditional breeding methods. Examples of traditional breeding methods can include cross-breeding, selfing, back-crossing, embryo rescue, in-crossing, out-crossing, inbreeding, selection, asexual propagation, and other traditional techniques as are known in the art.

Although exemplified with reference to specific plants or plant varieties and their hybrids, in various embodiments, the presently described methods using CESA-inhibiting herbicides can be employed with a variety of commercially valuable plants. CESA-inhibiting herbicides-tolerant plant lines described as useful herein can be employed in weed control methods either directly or indirectly, i.e. either as crops for herbicide treatment or as CESA-inhibiting herbicides-tolerance trait donor lines for development, as by traditional plant breeding, to produce other varietal and/or hybrid crops containing such trait or traits. AH such resulting variety or hybrids crops, containing the ancestral CESA-inhibiting herbicides-tolerance trait or traits can be referred to herein as progeny or descendant of the ancestral, CESA-inhibiting herbicides-tolerant line(s). Such resulting plants can be said to retain the "herbicide tolerance characteristic(s)" of the ancestral plant, i.e. meaning that they possess and express the ancestral genetic molecular components responsible for the trait.

In one aspect, the present invention provides a plant or plant part comprising a polynucleotide encoding a mutated CESA polypeptide, the expression of said polynucleotide confers to the plant or plant part tolerance to CESA-inhibiting herbicides.

In a preferred embodiment, the plant has been previously produced by a process comprising recombinantly preparing a plant by introducing and over-expressing a mutated CESA transgene according to the present invention, as described in greater detail hereinafter.

In another preferred embodiment, the plant has been previously produced by a process comprising in situ mutagenizing plant cells or seeds, to obtain plant cells or plants which express a mutated CESA.

In another embodiment, the polynucleotide encoding the mutated CESA polypeptide polypeptide comprises the nucleic acid sequence set forth in SEQ ID NO: 84, 85, 86, 87, 88, 89, 90, 91, 92, 93, 94, 95, 96, 97, or 98, or a variant or derivative thereof.

In other embodiments, the mutated CESA polypeptide for use according to the present invention is a functional variant having, over the full-length of the variant, at least about 80%, illustratively, at least about 80%, 90%, 95%, 98%, 99% or more amino acid sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83.

In another embodiment, the mutated CESA polypeptide for use according to the present invention is a functional fragment of a polypeptide having the amino acid sequence set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83.

It is recognized that the CESA polynucleotide molecules and CESA polypeptides of the invention encompass polynucleotide molecules and polypeptides comprising a nucleotide or an amino acid sequence that is sufficiently identical to nucleotide sequences set forth in SEQ ID Nos: 84, 85, 86, 87, 88, 89, 90, 91, 92, 93, 94, 95, 96, 97, or 98, or to the amino acid sequences set forth in SEQ ID Nos: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83. The term "sufficiently identical" is used herein to refer to a first amino acid or nucleotide sequence that contains a sufficient or minimum number of identical or equivalent (e.g., with a similar side chain) amino acid residues or nucleotides to a second amino acid or nucleotide sequence such that the first and second amino acid or nucleotide sequences have a common structural domain and/or common functional activity.

Generally, "sequence identity" refers to the extent to which two optimally aligned DNA or amino acid sequences are invariant throughout a window of alignment of components, e.g., nucleotides or amino acids. An "identity fraction" for aligned segments of a test sequence and a reference sequence is the number of identical components that are shared by the two aligned sequences divided by the total number of components in reference sequence segment, i.e., the entire reference sequence or a smaller defined part of the reference sequence. "Percent identity" is the identity fraction times 100. Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and preferably by computerized implementations of these algorithms such as GAP, BESTFIT, FASTA, and TFASTA available as part of the GCG. Wisconsin Package. (Accelrys Inc. Burlington, Mass.)

Polynucleotides and Oligonucleotides

By an "isolated polynucleotide", including DNA, RNA, or a combination of these, single or double stranded, in the sense or antisense orientation or a combination of both, dsRNA or otherwise, we mean a polynucleotide which is at least partially separated from the polynucleotide sequences with which it is associated or linked in its native state. Preferably, the isolated polynucleotide is at least 60% free, preferably at least 75% free, and most preferably at least 90% free from other components with which they are naturally associated. As the skilled addressee would be aware, an isolated polynucleotide can be an exogenous polynucleotide present in, for example, a transgenic organism which does not naturally comprise the polynucleotide. Furthermore, the terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

The term "mutated CESA nucleic acid" refers to a CESA nucleic acid having a sequence that is mutated from a wild-type CESA nucleic acid and that confers increased CESA-inhibiting herbicide tolerance to a plant in which it is expressed. Furthermore, the term "mutated cellulose synthase (mutated CESA)" refers to the replacement of an amino acid of the wild-type primary sequences of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, or a variant, a derivative, a homologue, an orthologue, or paralogue thereof, with another amino acid. The expression "mutated amino acid" will be used below to designate the amino acid which is replaced by another amino acid, thereby designating the site of the mutation in the primary sequence of the protein.

In a preferred embodiment, the CESA nucleotide sequence encoding a mutated CESA comprises the sequence of SEQ ID NO: 84, 85, 86, 87, 88, 89, 90, 91, 92, 93, 94, 95, 96, 97, or 98, or a variant or derivative thereof Furthermore, it will be understood by the person skilled in the art that the CESA nucleotide sequences encompass homologues, paralogues and orthologues of SEQ ID NO: 84, 85, 86, 87, 88, 89, 90, 91, 92, 93, 94, 95, 96, 97, or 98, as defined hereinafter.

The term "variant" with respect to a sequence (e.g., a polypeptide or nucleic acid sequence such as—for example—a transcription regulating nucleotide sequence of the invention) is intended to mean substantially similar sequences. For nucleotide sequences comprising an open reading frame, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis and for open reading frames, encode the native protein comprising the sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, as well as those that encode a polypeptide having amino acid substitutions relative to the native protein, e.g. the mutated CESA according to the present invention as disclosed herein. Generally, nucleotide sequence variants of the invention will have at least 30, 40, 50, 60, to 70%, e.g., preferably 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98% and 99% nucleotide "sequence identity" to the nucleotide sequence of SEQ ID NO: 84, 85, 86, 87, 88, 89, 90, 91, 92, 93, 94, 95, 96, 97, or 98. The % identity of a polynucleotide is determined by GAP (Needleman and Wunsch, 1970) analysis (GCG program) with a gap creation penalty=5, and a gap extension penalty=0.3. Unless stated otherwise, the query sequence is at least 45 nucleotides in length, and the GAP analysis aligns the two sequences over a region of at least 45 nucleotides. Preferably, the query sequence is at least 150 nucleotides in length, and the GAP analysis aligns the two sequences over a region of at least 150 nucleotides. More preferably, the query sequence is at least 300 nucleotides in length and the GAP analysis aligns the two sequences over a region of at least 300 nucleotides. Even more preferably, the GAP analysis aligns the two sequences over their entire length.

Polypeptides

By "substantially purified polypeptide" or "purified" a polypeptide is meant that has been separated from one or more lipids, nucleic acids, other polypeptides, or other contaminating molecules with which it is associated in its native state. It is preferred that the substantially purified polypeptide is at least 60% free, more preferably at least 75% free, and more preferably at least 90% free from other components with which it is naturally associated. As the skilled addressee will appreciate, the purified polypeptide can be a recombinantly produced polypeptide. The terms "polypeptide" and "protein" are generally used interchangeably and refer to a single polypeptide chain which may or may not be modified by addition of non-amino acid groups. It would be understood that such polypeptide chains may associate with other polypeptides or proteins or other molecules such as co-factors. The terms "proteins" and "polypeptides" as used herein also include variants, mutants, modifications, analogous and/or derivatives of the polypeptides of the invention as described herein.

The % identity of a polypeptide is determined by GAP (Needleman and Wunsch, 1970) analysis (GCG program) with a gap creation penalty=5, and a gap extension penalty=0.3. The query sequence is at least 25 amino acids in length, and the GAP analysis aligns the two sequences over a region of at least 25 amino acids. More preferably, the query sequence is at least 50 amino acids in length, and the GAP analysis aligns the two sequences over a region of at least 50 amino acids. More preferably, the query sequence is at least 100 amino acids in length and the GAP analysis aligns the two sequences over a region of at least 100 amino acids. Even more preferably, the query sequence is at least 250 amino acids in length and the GAP analysis aligns the two sequences over a region of at least 250 amino acids. Even more preferably, the GAP analysis aligns the two sequences over their entire length.

With regard to a defined polypeptide, it will be appreciated that % identity figures higher than those provided above will encompass preferred embodiments. Thus, where applicable, in light of the minimum % identity figures, it is preferred that the CESA polypeptide of the invention comprises an amino acid sequence which is at least 40%, more preferably at least 45%, more preferably at least 50%, more preferably at least 55%, more preferably at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83.

By "variant" polypeptide is intended a polypeptide derived from the protein of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, by deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Such variants may result from, for example, genetic polymorphism or from human manipulation. Methods for such manipulations are generally known in the art.

"Derivatives" of a protein encompass peptides, oligopeptides, polypeptides, proteins and enzymes having amino acid substitutions, deletions and/or insertions relative to the unmodified protein in question and having similar biological and functional activity as the unmodified protein from which they are derived. Thus, functional variants and fragments of the CESA polypeptides, and nucleic acid molecules encoding them, also are within the scope of the present invention, and unless specifically described otherwise, irrespective of the origin of said polypeptide and irrespective of whether it occurs naturally. Various assays for functionality of a CESA polypeptide can be employed. For example, a functional variant or fragment of the CESA polypeptide can be assayed to determine its ability to confer CESA-inhibiting herbicides tolerance. By way of illustration, a CESA-inhibiting herbicides tolerance can be defined as insensitivity to CESA inhibiting herbicides sufficient to provide a determinable increase in tolerance to CESA-inhibiting herbicides in a plant or plant part comprising a recombinant polynucleotide encoding the variant or fragment of the CESA polypeptide, wherein the plant or plant part expresses the variant or fragment at up to about 0.5%, illustratively, about 0.05 to about 0.5%, about 0.1 to about 0.4%, and about 0.2 to about 0.3%, of the total cellular protein relative to a similarly treated control plant that does not express the variant or fragment.

In a preferred embodiment, the mutated CESA polypeptide is a functional variant or fragment of a cellulose synthase having the amino acid sequence set forth in SEQ ID NO: 1, 3, 11, 16, 20, 23, 28, 35, 45, 51, 55, 66, 69, 74, 75, 79, or 80 wherein the functional variant or fragment has at least about 80% amino acid sequence identity to SEQ ID NO: 1, 3, 11, 16, 20, 23, 28, 35, 45, 51, 55, 66, 69, 74, 75, 79, or 80.

In other embodiments, the functional variant or fragment further has a CESA-inhibiting herbicides tolerance defined as insensitivity to CESA inhibiting herbicides sufficient to provide a determinable increase in tolerance to CESA-inhibiting herbicides in a plant or plant part comprising a recombinant polynucleotide encoding the variant or fragment, wherein the plant or plant part expresses the variant or fragment at up to about 0.5% of the total cellular protein to a similarly treated control plant that does not express the variant or fragment.

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

In addition, one of ordinary skill in the art will further appreciate that changes can be introduced by mutation into the nucleotide sequences of the invention thereby leading to changes in the amino acid sequence of the encoded proteins without altering the biological activity of the proteins. Thus, for example, an isolated polynucleotide molecule encoding a mutated CESA polypeptide having an amino acid sequence that differs from that of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, can be created by introducing one or more nucleotide substitutions, additions or deletions into the corresponding nucleotide sequence, such that one or more amino acid substitutions, additions or deletions are introduced into the encoded protein. Mutations can be introduced by standard techniques, such as site-directed mutagenesis and PCR-mediated mutagenesis. Such variant nucleotide sequences are also encompassed by the present invention. For example, preferably, conservative amino acid substitutions may be made at one or more predicted preferably nonessential amino acid residues. A "nonessential" amino acid residue is a residue that can be altered from the wild-type sequence of a protein without altering the biological activity, whereas an "essential" amino acid residue is required for biological activity.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. A conservative amino acid substitution is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Such substitutions would not be made for conserved amino acid residues, or for amino acid residues residing within a conserved motif. Conservative substitution tables are well known in the art (see for example Creighton (1984) Proteins. W.H. Freeman and Company (Eds).

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, OH), Quick-Change Site Directed mutagenesis (Stratagene, San Diego, CA), PCR-mediated site-directed mutagenesis or other site-directed mutagenesis protocols.

"Derivatives" further include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

"Orthologues" and "paralogues" encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene. A non-limiting list of examples of such orthologues is shown in Table 1. It will be understood by the person skilled in the art that the sequences of SEQ ID NOs: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, as listed in Table 1 represent orthologues and paralogues to SEQ ID NO:1.

It is well-known in the art that paralogues and orthologues may share distinct domains harboring suitable amino acid residues at given sites, such as binding pockets for particular substrates or binding motifs for interaction with other proteins.

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

i) Motif 1a:
(SEQ ID NO: 99)
L[C/G/M/S][F/V/L/I]F[L/F][Q/H/R]YR[T/V/C/I]

[T/S/M/L][H/N]P[V/A][K/N/P/R/T][N/D]A[Y/F]

[P/G/A/T]LWL[T/V/I/L]SVICE[I/V]WFA[F/L/I/V/M]SW.

Preferably said motif is (motif 1b; SEQ ID NO: 100)
L[C/G/M/S][F/V/L/I]F[L/F][Q/H]YR[T/V/C/I][T/S/L]

[H/N]PV[K/N/P/R/T/E][N/D]A[Y/F][P/G/A/T]LWL

[T/V/I/L]SVICE[I/V]WFA[F/L/I/V]SW

More preferably said motif is (motif 1c; SEQ ID NO: 101)
L[C/G/M][F/V]F[L/F][Q/H]YR[T/V/C/I][T/S]HPV

[K/N/R/E][N/D]AY[P/G/A]LWL[T/V]SVICE[I/V]WFA

[F/L]SW ii) Motif 2a:
(SEQ ID NO: 102)
YC[I/T/V/M/S/A]LPA[F/V/I]CL[I/[/F]T[D/N/G]

[R/K/T/Q]FI[I/V/T]P[E/A/Q/K][I/L][S/N/T]N

[Y/F/L/I/A][A/E][S/G][I/M/L/A/V][W/C/F/L/V/I]F

[I/M/L/V][L/S][L/S/A]F[I/V/A/L/S/M/G][S/C]I

Preferably, said motif is (motif 2h; SEQ ID NO: 103)
YC[I/T/V/M]LPA[F/VACL[I/L/F]T[D/N/G][R/K/T/Q]FIIP

[E/A/Q/K]ISN[Y/F/L/I][A/E][S/G][I/M/L/A/V]

[W/C/F]F[I/M/L][L/S]LF[I/V/A/L]SI;

More preferably said motif is (motif 2c; SEQ ID NO: 104)
YC[I/T/V/M]LPA[F/VACL[I/L]T[D/N/G][R/K/T]FIIP

[E/A]ISN[Y/F/L]A[S/G][I/M/L/A][W/C/F]F[I/M]LLF

[I/V/A]SI iii) Motif 3a:
(SEQ ID NO: 105)
VIGG[T/V/I/A]S[A/S]H[L/F][F/L]A[V/L][F/V][Q/L]G

[L/I/M][L/F]KV[L/F/I]AG[I/V][D/N/S/E/K]T[N/S]F

[T/I]V[T/A]SK

Preferably, said motif is (motif 3h; SEQ ID NO: 106)
VIGG[T/VASAHLFAVFQG[LALKV[L/F]AGIDT[N/S]FTVTSK;

More preferably said motif is (motif 3c; SEQ ID NO: 107)
VIGGTSAHLFAVFQGLLKV[L/F]AGIDTNFTVTSK iv) Motif 4a:
(SEQ ID NO: 108)
A[V/I][N/S][S/N]G[Y/F][Q/D/E]SWGPL[F/M/[]G[K/R]L

[F/L]F[A/S][L/I/F]WV[I/V][A/V/I/L]HLYPFLKG[L/M/V]

[L/M/V(I]G

-continued

Preferably, said motif is (motif 4h; SEQ ID NO: 109)
A[VANSGYQSWGPL[F/M]GKL[F/[]F[A/S][L/I/F]WV[I/V]

[A/V/I/L]HLYPFLKGL[LM]G;

More preferably said motif is (motif 4c; SEQ ID NO: 110)
A[VANSGYQSWGPL[F/M]GKL[F/L]F[A/S][L/I/F]WV[I/V]

[A/V/L]HLYPFLKGL[LM]G v) Motif 5a:

(SEQ ID NO: 111)
[G/A][I/M/V][V/I][A/S/V]G[V/I/F]S[Y/T/D/N]A[V/I]

[N/S][S/N]G[Y/F]

Preferably, said motif is (motif 5b; SEQ ID NO: 112)
G[I/M/V]V[A/S]G[V/I/F]S[Y/T]A[VANSGY;

More preferably said motif is (motif 5c; SEQ ID NO: 113)
GVVAG[V/I/F]SYAINSGY vi) Motif 6a:

(SEQ ID NO: 114)
[V/I][I/V/L]VW[S/A][V/I/A]L[LI][A/S]S[I/F][F/L]

[S/T][L/V][LM]WV[R/K][I/V][N/D]PF

Preferably, said motif is (motif 6b; SEQ ID NO: 115)
V[I/V]VW[S/A][V/I/A]LLASIFSL[LM]WV[R/K]I[N/D]PF;

More preferably said motif is (motif 6c; SEQ ID NO: 116)
VVVW[S/A][V/I]LLASIFSL[LM]WVRIDPF vii) Motif 7a:

(SEQ ID NO: 117)
EI[L/FR/F/M]S[R/K/MHCP[I/L]WYGY[H/T/N/S/G][G/C]

[R/K/G]L

Preferably, said motif is (motif 7b; SEQ ID NO: 118)
EI[L/FR/F]SRHCP[I/L]WYGY[H/T/N/S/G][G/C][R/K/G]L;

More preferably said motif is (motif 7c; SEQ ID NO: 119)
EILFSRHCP[I/L]WYGY[N/S/G]GRL viii) Motif 8a:

(SEQ ID NO: 120)
[F/L]KWT[A/S/T]LLI[P/T]P[T/M/L]T[V/I/L]L

Preferably, said motif is (motif 8h; SEQ ID NO: 121);
FKWT[A/S/T]LLIPPTT[V/I/L]L More preferably said motif is (motif 8c; SEQ ID NO: 122)
FKWT[A/S/T]LLIPPTT[V/I]L Motifs 1a-c, 2a-c, 3a-c, 4a-c, 5a-c, 6a-c, 7a-c, 8a-c given above were derived using the ClustalW algorithm to generate the alignments of cellulose synthase sequences (FIG. 2 A-C) (Larkin et al., Bioinformatics 23:21 (2007) 2947-2948 pp. 28-36). The motifs were essentially derived based on sequence alignment (FIG. 2 A-F); highly conserved regions were identified that contain the site of mutations conferring azine-herbicide tolerance. Residues within square brackets represent alternatives.

In a preferred embodiment, a CESA polypeptide as applied herein comprises, at least 1, at least 2, at least 3, at least 4, at least 5, at least 6, at least 7 motifs selected from the group comprising motifs 1a, 2a, 3a, 4a, 5a, 6a, 7a, and 8a as given above. Alternatively or in addition, in another preferred embodiment, a CESA polypeptide as applied herein comprises at least 1, at least 2, at least 3, at least 4, at least 5, at least 6, at least 7 motifs selected from the group comprising motifs 1b, 2b, 3b, 4b, 5b, 6b, 7b, and 8b as given above. Alternatively or in addition, in another preferred embodiment, a CESA polypeptide as applied herein comprises at least 1, at least 2, at least 3, at least 4, at least 5, at least 6, at least 7 motifs selected from the group comprising motifs 1c, 2c, 3c, 4c, 5c, 6c, 7c, and 8c as given above.

Additionally or alternatively, the homologue of a CESA protein has in increasing order of preference at least 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, provided that the homologous protein comprises any one or more of the conserved motifs 1, 2, 3, 4, 5, 6, 7, and/or 8 as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in a CESA polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 99, 100, 101, 102, 103, 104, 105, 106, 107, 108, 109, 110, 111, 112, 113, 114, 115, 116, 117, 118, 119, 120, 121, 122 (Motifs 1a, 1b, 1c, 2a, 2b, 2c, 3a, 3b, 3c, 4a, 4b, 4c, 5a, 5b, 5c, 6a, 6b, 6c, 7a, 7b, 7c, 8a, 8b, 8c).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids.

Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Figure 1B:
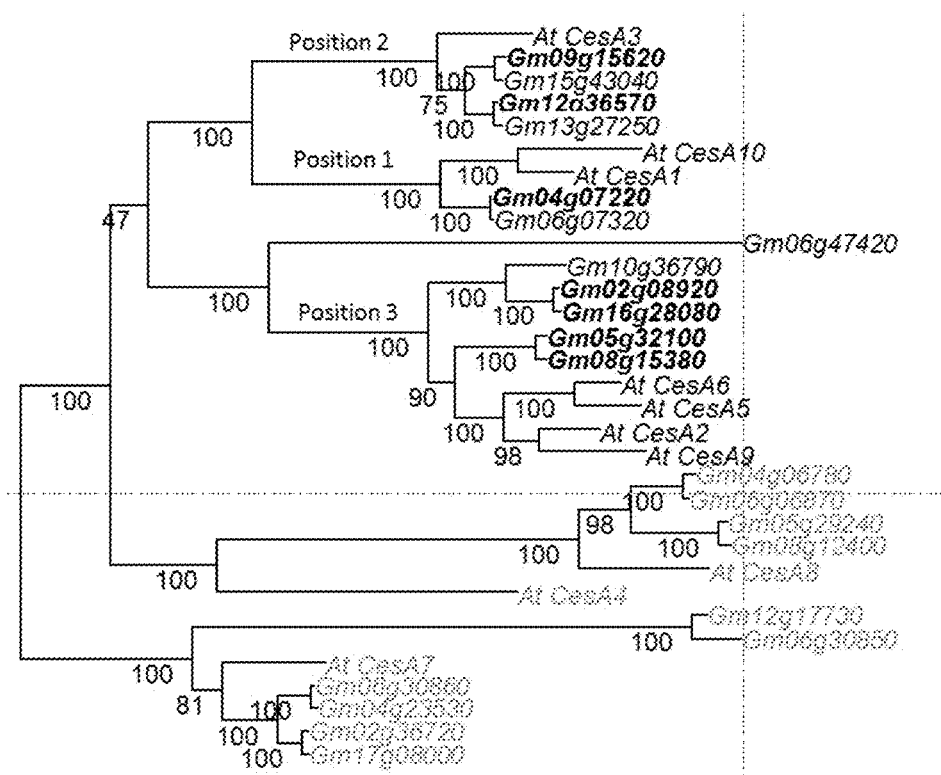
Figure 1C:
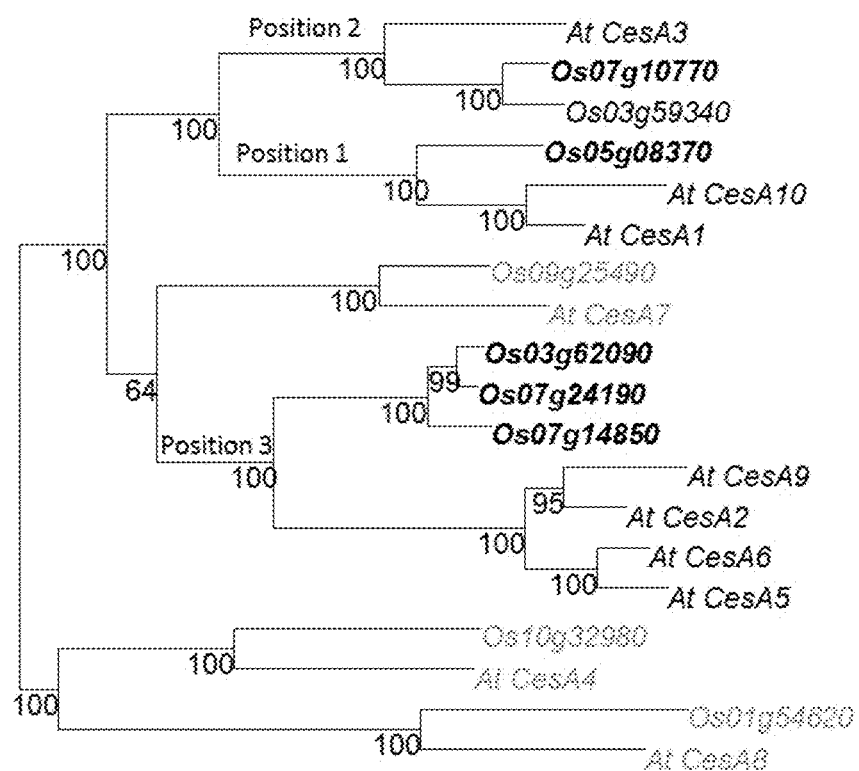
Figure 1D:
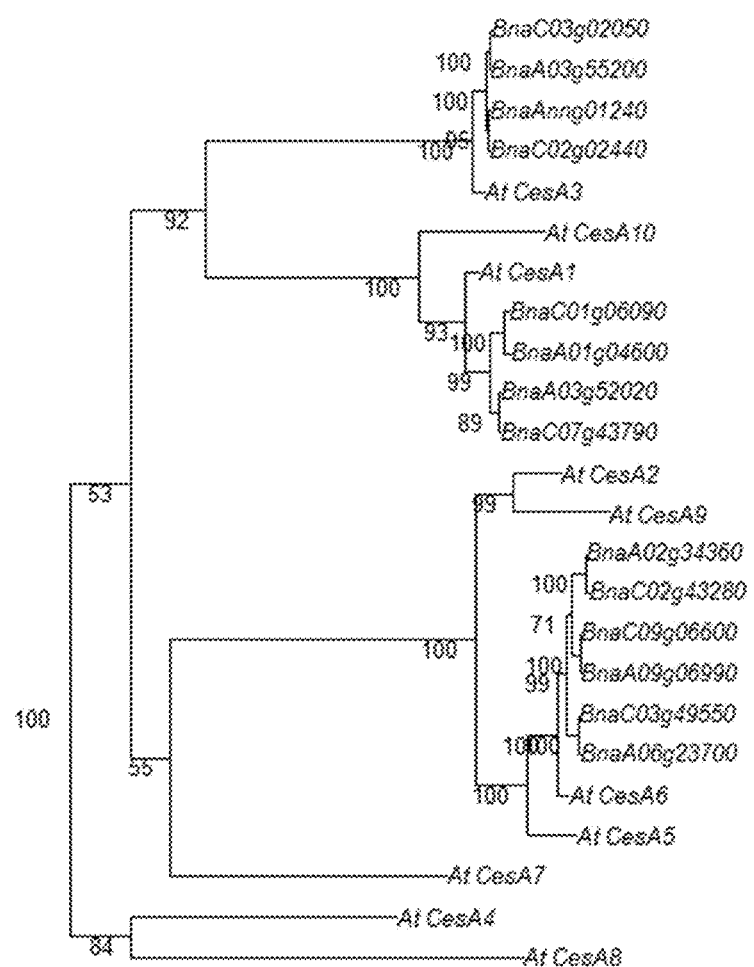
Figure 1E:
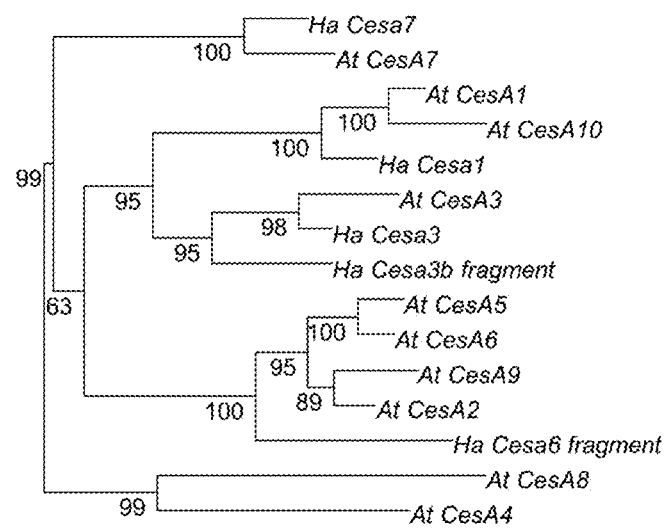

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage (See FIG. 1). Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

The proteins of the invention may be altered in various ways including amino acid substitutions, deletions, truncations, and insertions. Methods for such manipulations are generally known in the art. For example, amino acid sequence variants can be prepared by mutations in the DNA. Methods for mutagenesis and nucleotide sequence alterations are well known in the art. See, for example, Kunkel (1985) PNAS, 82:488-492; Kunkel et al. (1987) Methods in Enzymol. 154:367-382; U.S. Pat. No. 4,873,192; Walker and Gaastra, eds. (1983) Techniques in Molecular Biology (MacMillan Publishing Company, New York) and the references cited therein. Guidance as to appropriate amino acid substitutions that do not affect biological activity of the protein of interest may be found in the model of Dayhoff et al. (1978) Atlas of Protein Sequence and Structure (Natl. Biomed. Res. Found., Washington, D.C), herein incorporated by reference. Conservative substitutions, such as exchanging one amino acid with another having similar properties, may be preferable.

Alternatively, variant nucleotide sequences can be made by introducing mutations randomly along all or part of a coding sequence, such as by saturation mutagenesis, and the resultant mutants can be screened to identify mutants that encode proteins that retain activity. For example, following mutagenesis, the encoded protein can be expressed recombinantly, and the activity of the protein can be determined using standard assay techniques.

The inventors of the present invention have found that by substituting one or more of the key amino acid residues of the CESA enzyme of SEQ ID NO: 1, 3, 12, 15, 20, or 21 e.g. by employing one of the above described methods to mutate the CESA encoding nucleic acids, the tolerance or resistance to particular CESA-inhibiting herbicides, collectively named azines, and described in great detail herein below, could be remarkably increased Preferred substitutions of mutated CESA are those that increase the herbicide tolerance of the plant, but leave the biological activity of the cellulose synthase activity substantially unaffected.

Accordingly, in another object of the present invention refers to a CESA polypeptide, comprising the sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, a variant, derivative, orthologue, paralogue or homologue thereof, the key amino acid residues of which is substituted by any other amino acid.

It will be understood by the person skilled in the art that amino acids located in a close proximity to the positions of amino acids mentioned below may also be substituted. Thus, in another embodiment the variant of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, a variant, derivative, orthologue, paralogue or homologue thereof comprises a mutated CESA, wherein an amino acid ±3, ±2 or ±1 amino acid positions from a key amino acid is substituted by any other amino acid.

Based on techniques well-known in the art, a highly characteristic sequence pattern can be developed, by means of which further of mutated CESA candidates with the desired activity may be searched.

Searching for further mutated CESA candidates by applying a suitable sequence pattern would also be encompassed by the present invention. It will be understood by a skilled reader that the present sequence pattern is not limited by the exact distances between two adjacent amino acid residues of said pattern. Each of the distances between two neighbours in the above patterns may, for example, vary independently of each other by up to ±10, ±5, ±3, ±2 or ±1 amino acid positions without substantially affecting the desired activity.

Furthermore, by applying the method of site directed mutagenesis, in particular saturation mutagenes (see e.g. Schenk et al., Biospektrum March 2006, pages 277-279) PCR based site-directed mutagenesis (e.g. directed mutagenesis kit, Stratagene, California, USA or GeneArt Mutagenesis Service, ThermoFisher Scientific Inc., Massachusetts, USA) or systematic mutagenesis (GeneArt Systematic Mutagenesis Service, ThermoFisher Scientific Inc., Massachusetts, USA), the inventors of the present invention have identified and generated specific amino acid substitutions and combinations thereof, which—when introduced into a plant by transforming and expressing the respective mutated CESA encoding nucleic acid-confer increased herbicide resistance or tolerance to a CESA inhibiting herbicide to said plant.

Thus, in preferred embodiment, the variant or derivative of the CESA polypeptide refers to a mutated CESA polypeptide which comprises one or more of the following motifs:

i) Motif 1a:
(SEQ ID NO: 99)
L[C/G/M/S][F/V/L/I]F[L/F][Q/H/R]YR[T/V/C/I]
[T/S/M/L][H/N]PV[K/N/P/R/T/E][N/D]A[Y/F]
[P/G/A/T]LWL[T/V/I/L]SVICE[I/V]WFA[F/L/I/V/M]SW.

Preferably said motif is
(motif 1b; SEQ ID NO: 100)
L[C/G/M/S][F/V/L/I]F[L/F][Q/H]YR[T/V/C/I][T/S/L]
[H/N]PV[K/N/P/R/T/E][N/D]A[Y/F][P/G/A/T]LWL
[T/V/I/L]SVICE[I/V]WFA[F/L/I/V]SW More preferably said motif is
(motif 1c; SEQ ID NO:101)
L[C/G/M][F/V]F[L/F][Q/H]YR[T/V/C/I][T/S]HPV
[K/N/R/E][N/D]AY[P/G/A]LWL[T/V]SVICE[I/V]WFA[F/L]
SW Wherein the amino acid at position 8, and/or 23 within said motif of the corresponding wildtype sequence is substituted by any other amino acid ii) Motif 2a:
(SEQ ID NO: 102)
YC[I/T/V/M/S/A]LPA[F/V/I]CL[I/L/F]T[D/N/G]
[R/K/T/Q]FI[I/V/T]P[E/A/Q/K][I/L][S/N/T]N
[Y/F/L/I/A][A/E][S/G][I/M/L/A/V][W/C/F/L/V/I]F
[I/M/L/V][L/S][L/S/A]F[I/V/A/L/S/M/G][S/C]I Preferably, said motif is
(motif 2 b; SEQ ID NO: 103)
YC[I/T/V/M]LPA[F/VACL[I/L/F]T[D/N/G][R/K/T/Q]FIIP
[E/A/Q/K]ISN[Y/F/L/I][A/E][S/G][I/M/L/A/V][W/C/F]
F[I/M/L][L/S]LF[I/V/A/L]SI;

More preferably said motif is
(motif 2c; SEQ ID NO: 104)
YC[I/T/V/M]LPA[F/VACL[I/L]T[D/N/G][R/K/T]FIIP
[E/A]ISN[Y/F/L]A[S/G][I/M/L/A][W/C/F]F[I/M]LLF
[I/V/A]SI Wherein the amino acid at position 4, 17, and/or 24 within said motif of the corresponding wildtype sequence is substituted by any other amino acid iii) Motif 3a:
(SEQ ID NO: 105)
VIGG[T/V/I/A]S[A/S]H[L/F][F/L]A[V/L][F/V][Q/L]G
[L/I/M][L/F]KV[L/F/I]AG[I/V][D/N/S/E/K]T[N/S]F
[T/I]V[T/A]SK Preferably, said motif is
(motif 3b; SEQ ID NO: 106)
VIGG[T/V/I]SAHLFAVFQG[L/I]LKV[L/F]AGIDT[N/S]FTVT
SK;

More preferably said motif is
(motif 3c; SEQ ID NO: 107)
VIGGTSAHLFAVFQGLLKV[L/F]AGIDTNFTVTSK Wherein the amino acid at position 1, 3, 18, and/or 28 within said motif of the corresponding wildtype sequence is substituted by any other amino acid iv) Motif 4a:
(SEQ ID NO: 108)
A[V/I][N/S][S/N]G[Y/F][Q/D/E]SWGPL[F/M/L]G[K/R]L
[F/L]F[A/S][L/I/F]WV[I/V][A/V/I/L]HLYPFLKG[L/M/V]
[L/M/V(I]G Preferably, said motif is
(motif 4b; SEQ ID NO: 109)
A[VANSGYQSWGPL[F/M]GKL[F/L]F[A/S][L/I/F]WV[I/V]
[A/V/I/L]HLYPFLKGL[L/M]G;

More preferably said motif is
(motif 4c; SEQ ID NO: 110)
A[VANSGYQSWGPL[F/M]GKL[F/L]F[A/S][L/I/F]WV[I/V]
[A/V/L]HLYPFLKGL[L/M]G Wherein the amino acid at position 9, 12, 13, 15, 19, and/or 24 within said motif of the corresponding wildtype sequence is substituted by any other amino acid v) Motif 5a:
(SEQ ID NO: 111)
[G/A][I/M/V][V/I][A/S/V]G[V/I/F]S[Y/T/D/N]A[V/I]
[N/S][S/N]G[Y/F]

Preferably, said motif is
(motif 5b; SEQ ID NO: 112)
G[I/M/V]V[A/S]G[V/I/F]S[Y/T]A[VANSGY;

More preferably said motif is
(motif 5c; SEQ ID NO: 113)
GVVAG[V/I/F]SYAINSGY

Wherein the amino acid at position 8 within said motif of the corresponding wildtype sequence is substituted by any other amino acid vi) Motif 6a:
(SEQ ID NO: 114)
[V/I][I/V/L]VW[S/A][V/I/A]L[LI][A/S]S[I/F][F/L]
[S/T][L/V][L/M]WV[R/K][I/V][N/D]PF Preferably, said motif is
(motif 6b; SEQ ID NO: 115)
V[I/V]VW[S/A][V/I/A]LLASIFSL[L/M]WV[R/K]I[N/D]PF;

-continued

More preferably said motif is

VVVW[S/A][VgLLASIFSL[L/M]WVRIDPF (motif 6c; SEQ ID NO: 116)

Wherein the amino acid at position 9, 11, 12, and/or 14 within said motif of the corresponding wildtype sequence is substituted by any other amino acid vii) Motif 7a:

EI[L/F][L/F/M]S[R/K/N]HCP[I/L]WYGY[H/T/N/S/G] (SEQ ID NO: 117)

[G/C][R/K/G]L

Preferably, said motif is

EI[L/F][L/F]SRHCP[I/L]WYGY[H/T/N/S/G][G/C] (motif 7b; SEQ ID NO: 118)

[R/K/G]L;

More preferably said motif is

EILFSRHCP[I/L]WYGY[N/S/G]GRL (motif 7c; SEQ ID NO: 119)

Wherein the amino acid at position 5, 13, 15, and/or 16 within said motif of the corresponding wildtype sequence is substituted by any other amino acid viii) Motif 8a:

[F/L]KWT[A/S/T]LLI[P/T]P[T/M/L]T[V/I/L]L (SEQ ID NO: 120)

Preferably, said motif is

FKWT[A/S/T]LLIPPTT[V/I/L]L; (motif 8b; SEQ ID NO: 121)

More preferably said motif is

FKWT[A/S/T]LLIPPTT[V/I]L (motif 8c; SEQ ID NO: 122)

Wherein the amino acid at position 10 within said motif of the corresponding wildtype sequence is substituted by any other amino acid In a more preferred embodiment, the amino acid corresponding to position 8 of motif 1a, 1b, or 1c is:

Ala, Asn, Asp, Cys, Gln, Glu, Gly, His, He, Leu, Lys, Met, Phe, Pro, Ser, Thr, Trp, Tyr, or Val And/or the amino acid corresponding to position 23 of motif 1a, 1b, or 1c is Ala, Arg, Asn, Asp, Cys, Gln, Glu, Gly, His, He, Leu, Lys, Met, Phe, Pro, Thr, Trp, Tyr, or Val In another more preferred embodiment, the amino acid corresponding to position 4 of motif 2a, 2b, or 2c is:

Ala, Arg, Asn, Asp, Cys, Gln, Glu, Gly, His, He, Lys, Met, Phe, Pro, Ser, Thr, Trp, Tyr, or Val

And/or the amino acid corresponding to position 17 of motif 2a, 2b, or 2c is Ala, Arg, Asn, Asp, Cys, Gln, Glu, Gly, His, He, Leu, Lys, Met, Phe, Ser, Thr, Trp, Tyr, or Val And/or the amino acid corresponding to position 24 of motif 2a, 2b, or 2c is Ala, Arg, Asn, Asp, Cys, Gln, Glu, Gly, His, He, Leu, Lys, Met, Phe, Pro, Thr, Trp, Tyr, Val In another more preferred embodiment, the amino acid corresponding to position 1 of motif 3a, 3b, or 3c is:

Ala, Arg, Asn, Asp, Cys, Gln, Glu, Gly, His, He, Leu, Lys, Met, Phe, Pro, Ser, Thr, Trp, Tyr, or Tyr,

And/or the amino acid corresponding to position 3 of motif 3a, 3b, or 3c is Ala, Arg, Asn, Asp, Cys, Gln, Glu, His, He, Leu, Lys, Met, Phe, Pro, Ser, Thr, Trp, Tyr, or Val And/or the amino acid corresponding to position 18 of motif 3a, 3b, or 3c is Ala, Arg, Asn, Asp, Cys, Gln, Glu, Gly, His, He, Leu, Met, Phe, Pro, Ser, Thr, Trp, Tyr, or Val And/or the amino acid corresponding to position 28 of motif 3a, 3b, or 3c is Ala, Arg, Asn, Asp, Cys, Gln, Glu, Gly, His, He, Leu, Lys, Met, Phe, Pro, Ser, Trp, Tyr, or Val In another more preferred embodiment, the amino acid corresponding to position 9 of motif 4a, 4b, or 4c is:

Ala, Arg, Asn, Asp, Cys, Gln, Glu, Gly, His, He, Leu, Lys, Met, Phe, Pro, Ser, Thr, Tyr, or Val

And/or the amino acid corresponding to position 12 of motif 4a, 4b, or 4c is

Ala, Arg, Asn, Asp, Cys, Gln, Glu, Gly, His, He, Lys, Met, Phe, Pro, Ser, Thr, Trp, Tyr, or Val

And/or the amino acid corresponding to position 13 of motif 4a, 4b, or 4c is Ala, Arg, Asn, Asp, Cys, Gln, Glu, Gly, His, He, Leu, Lys, Met, Pro, Ser, Thr, Trp, Tyr, or Val And/or the amino acid corresponding to position 15 of motif 4a, 4b, or 4c is Ala, Arg, Asn, Asp, Cys, Gln, Glu, Gly, His, He, Leu, Met, Phe, Pro, Ser, Thr, Tyr, or Val And/or the amino acid corresponding to position 19 of motif 4a, 4b, or 4c is Arg, Asn, Asp, Cys, Gln, Glu, Gly, His, He, Leu, Lys, Met, Phe, Pro, Ser, Thr, Trp, Tyr, or Val And/or the amino acid corresponding to position 24 of motif 4a, 4b, or 4c is Arg, Asn, Asp, Cys, Gln, Glu, Gly, His, He, Leu, Lys, Met, Phe, Pro, Ser, Thr, Trp, Tyr, or Val.

In another more preferred embodiment, the amino acid corresponding to position 8 of motif 5a, 5b, or 5c is:

Ala, Arg, Asn, Asp, Cys, Gln, Glu, Gly, His, He, Leu, Lys, Met, Phe, Pro, Ser, Thr, Trp, or Val

In another more preferred embodiment, the amino acid corresponding to position 9 of motif 6a, 6b, or 6c is:

Arg, Asn, Asp, Cys, Gln, Glu, Gly, His, He, Leu, Lys, Met, Phe, Pro, Ser, Thr, Trp, Tyr, or Val

And/or the amino acid corresponding to position 11 of motif 6a, 6b, or 6c is Ala, Arg, Asn, Asp, Cys, Gln, Glu, Gly, His, Leu, Lys, Met, Phe, Pro, Ser, Thr, Trp, Tyr, or Val And/or the amino acid corresponding to position 12 of motif 6a, 6b, or 6c is Ala, Arg, Asn, Asp, Cys, Gln, Glu, Gly, His, He, Leu, Lys, Met, Pro, Ser, Thr, Tyr, or Val And/or the amino acid corresponding to position 14 of motif 6a, 6b, or 6c is Ala, Arg, Asn, Asp, Cys, Gln, Glu, Gly, His, He, Lys, Met, Phe, Pro, Ser, Thr, Trp, Tyr, or Val In another more preferred embodiment, the amino acid corresponding to position 5 of motif 7a, 7b, or 7c is:

Ala, Arg, Asn, Asp, Cys, Gln, Glu, Gly, His, He, Leu, Lys, Met, Phe, Pro, Thr, Trp, Tyr, or Val

And/or the amino acid corresponding to position 13 of motif 7a, 7b, or 7c is Ala, Arg, Asn, Asp, Cys, Gln, Glu, His, He, Leu, Lys, Met, Phe, Pro, Ser, Thr, Trp, Tyr, or Val And/or
the amino acid corresponding to position 15 of motif 7a, 7b, or 7c is Ala, Arg, Asn, Cys, Gln, Glu, Gly, His, He, Leu, Lys, Met, Phe, Pro, Ser, Thr, Trp, Tyr, or Val
And/or
the amino acid corresponding to position 16 of motif 7a, 7b, or 7c is
Ala, Arg, Asn, Asp, Cys, Gln, Glu, His, He, Leu, Lys, Met, Phe, Pro, Ser, Thr, Trp, Tyr, or Val In another more preferred embodiment, the amino acid corresponding to position 10 of motif 8a, 8b, or 8c is:
Ala, Arg, Asn, Asp, Cys, Gln, Glu, Gly, His, He, Leu, Lys, Met, Phe, Ser, Thr, Trp, Tyr, or Val In a particularly preferred embodiment, the amino acid corresponding to position 8 of motif 1a, 1b, or 1c is His
And/or
the amino acid corresponding to position 23 of motif 1a, 1b, or 1c is Leu.

In another particularly preferred embodiment, the amino acid corresponding to position 4 of motif 2a, 2b, or 2c is: Phe
And/or
the amino acid corresponding to position 17 of motif 2a, 2b, or 2c is Ser.
And/or
the amino acid corresponding to position 24 of motif 2a, 2b, or 2c is Asn.

In another particularly preferred embodiment, the amino acid corresponding to position 1 of motif 3a, 3b, or 3c is: He
And/or
the amino acid corresponding to position 3 of motif 3a, 3b, or 3c is Asp
And/or
the amino acid corresponding to position 18 of motif 3a, 3b, or 3c is Arg
And/or
the amino acid corresponding to position 28 of motif 3a, 3b, or 3c is He.

In another particularly preferred embodiment, the amino acid corresponding to position 9 of motif 4a, 4b, or 4c is: Ala or Phe,
And/or
the amino acid corresponding to position 12 of motif 4a, 4b, or 4c is Ala or Phe,
And/or
the amino acid corresponding to position 13 of motif 4a, 4b, or 4c is Leu or Tyr
And/or
the amino acid corresponding to position 15 of motif 4a, 4b, or 4c is Arg or Gln,
And/or
the amino acid corresponding to position 19 of motif 4a, 4b, or 4c is Val
And/or
the amino acid corresponding to position 24 of motif 4a, 4b, or 4c is Thr.

In another particularly preferred embodiment, the amino acid corresponding to position 8 of motif 5a, 5b, or 5c is: Asp.

In another more preferred embodiment, the amino acid corresponding to position 9 of motif 6a, 6b, or 6c is: Leu or Phe
And/or
the amino acid corresponding to position 11 of motif 6a, 6b, or 6c is Ala or Phe
And/or
the amino acid corresponding to position 12 of motif 6a, 6b, or 6c is Leu And/or
the amino acid corresponding to position 14 of motif 6a, 6b, or 6c is Ala or Phe In another particularly preferred embodiment, the amino acid corresponding to position 5 of motif 7a, 7b, or 7c is: Asn,
And/or
the amino acid corresponding to position 13 of motif 7a, 7b, or 7c is Asp
And/or
the amino acid corresponding to position 15 of motif 7a, 7b, or 7c is Glu,
And/or
the amino acid corresponding to position 16 of motif 7a, 7b, or 7c is Glu In another particularly preferred embodiment, the amino acid corresponding to position 10 of motif 8a, 8b, or 8c is: Ser.

In another embodiment, the variant or derivative of the CESA polypeptide refers to a CESA polypeptide comprising SEQ ID NO: 1, a orthologue, paralogue, or homologue thereof, wherein the amino acid sequence differs from the wildtype amino acid sequence of a CESA polypeptide at one or more positions corresponding to the following positions of SEQ ID NO:1:
292, 297, 307, 872, 892, 945, 1008, 1011, 1012, 1014, 1018, 1023, 1031.

Examples of differences at these amino acid positions include, but are not limited to, one or more of the following:
the amino acid at or corresponding to position 292 is other than arginine;
the amino acid at or corresponding to position 297 is other than valine;
the amino acid at or corresponding to position 307 is other than serine;
the amino acid at or corresponding to position 872 is other than leucine;
the amino acid at or corresponding to position 892 is other than serine,
the amino acid at or corresponding to position 945 is other than lysine,
the amino acid at or corresponding to position 1008 is other than tryptophan,
the amino acid at or corresponding to position 1011 is other than leucine;
the amino acid at or corresponding to position 1012 is other than phenylalanine;
the amino acid at or corresponding to position 1014 is other than lysine;
the amino acid at or corresponding to position 1018 is other than alanine,
the amino acid at or corresponding to position 1023 is other than alanine,
the amino acid at or corresponding to position 1031 is other than glycine;

In some embodiments, the mutated CESA enzyme comprising SEQ ID NO: 1, a orthologue, paralogue, or homologue thereof, comprises one or more of the following:
the amino acid at or corresponding to position 292 is Ala, Asn, Asp, Cys, Gln, Glu, Gly, His, He, Leu, Lys, Met, Phe, Pro, Ser, Thr, Trp, Tyr, or Val;
the amino acid at or corresponding to position 297 is Ala, Asn, Asp, Cys, Gln, Glu, Gly, His, He, Leu, Lys, Met, Phe, Pro, Ser, Thr, Trp, Tyr, or Arg;
the amino acid at or corresponding to position 307 is Ala, Arg, Asn, Asp, Cys, Gln, Glu, Gly, His, Ile, Leu, Lys, Met, Phe, Pro, Thr, Trp, Tyr, or Val;

the amino acid at or corresponding to position 872 is Ala, Arg, Asn, Asp, Cys, Gln, Glu, Gly, His, Ile, Lys, Met, Phe, Pro, Ser, Thr, Trp, Tyr, or Val;

the amino acid at or corresponding to position 892 is Ala, Arg, Asn, Asp, Cys, Gln, Glu, Gly, His, Ile, Leu, Lys, Met, Phe, Pro, Thr, Trp, Tyr, or Val;

the amino acid at or corresponding to position 945 is Ala, Arg, Asn, Asp, Cys, Gln, Glu, Gly, His, He, Leu, Met, Phe, Pro, Ser, Thr, Trp, Tyr, or Val;

the amino acid at or corresponding to position 1008 is Ala, Arg, Asn, Asp, Cys, Gln, Glu, Gly, His, He, Leu, Lys, Met, Phe, Pro, Ser, Thr, Tyr, or Val;

the amino acid at or corresponding to position 1011 is Ala, Arg, Asn, Asp, Cys, Gln, Glu, Gly, His, He, Lys, Met, Phe, Pro, Ser, Thr, Trp, Tyr, or Val;

the amino acid at or corresponding to position 1012 is Ala, Arg, Asn, Asp, Cys, Gln, Glu, Gly, His, He, Leu, Lys, Met, Pro, Ser, Thr, Trp, Tyr, or Val;

the amino acid at or corresponding to position 1014 is Ala, Arg, Asn, Asp, Cys, Gln, Glu, Gly, His, He, Leu, Met, Phe, Pro, Ser, Thr, Trp, Tyr, or Val;

the amino acid at or corresponding to position 1018 is Arg, Asn, Asp, Cys, Gln, Glu, Gly, His, He, Leu, Lys, Met, Phe, Pro, Ser, Thr, Trp, Tyr, or Val;

the amino acid at or corresponding to position 1023 is Arg, Asn, Asp, Cys, Gln, Glu, Gly, His, He, Leu, Lys, Met, Phe, Pro, Ser, Thr, Trp, Tyr, or Val;

the amino acid at or corresponding to position 1031 is Arg, Asn, Asp, Cys, Gln, Glu, Ala, His, He, Leu, Lys, Met, Phe, Pro, Ser, Thr, Trp, Tyr, or Val;

In a preferred embodiment, the amino acid at or corresponding to position 292 of SEQ ID NO: 1 is His.

In a preferred embodiment, the amino acid at or corresponding to position 297 of SEQ ID NO: 1 is Met.

In another preferred embodiment, the amino acid at or corresponding to position 307 of SEQ ID NO: 1 is Leu, In another preferred embodiment, the amino acid at or corresponding to position 872 of SEQ ID NO: 1 is Phe, In another preferred embodiment, the amino acid at or corresponding to position 892 of SEQ ID NO: 1 is Asn, In another preferred embodiment, the amino acid at or corresponding to position 945 of SEQ ID NO: 1 is Arg, In another preferred embodiment, the amino acid at or corresponding to position 1008 of SEQ ID NO: 1 is Phe or Ala In another preferred embodiment, the amino acid at or corresponding to position 1011 of SEQ ID NO: 1 is Phe or Ala;

In another preferred embodiment, the amino acid at or corresponding to position 1012 of SEQ ID NO: 1 is Leu or Tyr;

In another preferred embodiment, the amino acid at or corresponding to position 1014 of SEQ ID NO: 1 is Arg, or Gln;

In another preferred embodiment, the amino acid at or corresponding to position 1018 of SEQ ID NO: 1 is Val;

In another preferred embodiment, the amino acid at or corresponding to position 1023 of SEQ ID NO: 1 is Thr.

In another preferred embodiment, the amino acid at or corresponding to position 1031 of SEQ ID NO: 1 is Arg.

In another embodiment, the variant or derivative of the CESA polypeptide refers to a CESA polypeptide comprising SEQ ID NO: 3, a orthologue, paralogue, or homologue thereof, wherein the amino acid sequence differs from the wildtype amino acid sequence of a CESA polypeptide at one or more positions corresponding to the following positions of SEQ ID NO:3:

984, 1036, 1038, 1039, 1041.

Examples of differences at these amino acid positions include, but are not limited to, one or more of the following:

the amino acid at or corresponding to position 984 is other than tyrosine;

the amino acid at or corresponding to position 1036 is other than alanine;

the amino acid at or corresponding to position 1038 is other than isoleucine;

the amino acid at or corresponding to position 1039 is other than phenylalanine, the amino acid at or corresponding to position 1041 is other than Leucine, In some embodiments, the mutated CESA enzyme comprising SEQ ID NO: 3, a orthologue, paralogue, or homologue thereof, comprises one or more of the following:

the amino acid at or corresponding to position 984 is Ala, Arg, Asn, Asp, Cys, Gln, Glu, Gly, His, He, Leu, Lys, Met, Phe, Pro, Ser, Thr, Trp, or Val the amino acid at or corresponding to position 1036 is Arg, Asn, Asp, Cys, Gln, Glu, Gly, His, He, Leu, Lys, Met, Phe, Pro, Ser, Thr, Trp, Tyr, or Val the amino acid at or corresponding to position 1038 is Ala, Arg, Asn, Asp, Cys, Gln, Glu, Gly, His, Leu, Lys, Met, Phe, Pro, Ser, Thr, Trp, Tyr, or Val the amino acid at or corresponding to position 1039 is Ala, Arg, Asn, Asp, Cys, Gln, Glu, Gly, His, He, Leu, Lys, Met, Pro, Ser, Thr, Trp, Tyr, Val the amino acid at or corresponding to position 1041 is Ala, Arg, Asn, Asp, Cys, Gln, Glu, Gly, His, He, Lys, Met, Phe, Pro, Ser, Thr, Trp, Tyr, Val In a preferred embodiment, the amino acid at or corresponding to position 984 of SEQ ID NO: 3 is Asp, In another preferred embodiment, the amino acid at or corresponding to position 1036 of SEQ ID NO: 3 is Leu or Phe In another preferred embodiment, the amino acid at or corresponding to position 1038 of SEQ ID NO: 3 is Ala, or Phe, In another preferred embodiment, the amino acid at or corresponding to position 1039 of SEQ ID NO: 3 is Leu, In another preferred embodiment, the amino acid at or corresponding to position 1041 of SEQ ID NO: 3 is Ala, or Phe, It will be within the knowledge of the skilled artisan to identify conserved regions and motifs shared between the homologues, orthologues and paralogues encoded by SEQ ID NO: 84, 85, 86, 87, 88, 89, 90, 91, 92, 93, 94, 95, 96, 97, or 98, such as those depicted in Table 1. Having identified such conserved regions that may represent suitable binding motifs, amino acids corresponding to the amino acids listed below in Table 2, can be chosen to be substituted by any other amino acid, for example by conserved amino acids, preferably by the amino acid substitutions described SUPRA using SEQ ID NO:1 or 3 as reference.

Table 2 A and B provide an overview of positions in the orthologues and homologues to SEQ ID NO:1 or SEQ ID NO:3, i.e. the corresponding positions in SEQ ID NOs: 1 to 83.

TABLE 2 A

| ID | Pos 1 | Pos 2 | Pos 3 | Pos 4 | Pos 5 | Pos 6 | Pos 7 | Pos 8 | Pos 9 | Pos 10 | Pos 11 | Pos 12 | Pos 13 |
|---|---|---|---|---|---|---|---|---|---|---|---|---|---|
| 1 | R292 | S307 | L872 | S892 | K945 | W1008 | L1011 | F1012 | K1014 | A1018 | A1023 | V297 | G1031 |
| 2 | R294 | S309 | L876 | G896 | K949 | W1011 | L1014 | F1015 | R1017 | A1021 | V1026 | V299 | G1034 |
| 3 | R276 | S291 | L857 | S877 | K930 | W993 | L996 | F997 | K999 | A1003 | V1008 | V281 | G1016 |
| 4 | R232 | S247 | I840 | S860 | K913 | W977 | L980 | F981 | K983 | A987 | V992 | A237 | G1000 |
| 5 | R281 | S296 | L862 | S882 | K935 | W997 | L1000 | F1001 | R1003 | A1007 | L1012 | V286 | G1020 |
| 6 | R293 | S308 | L877 | G897 | K950 | W1012 | L1015 | F1016 | R1018 | A1022 | I1027 | V298 | G1035 |
| 7 | R255 | S270 | L8T9 | S839 | K892 | W954 | L957 | F958 | K960 | S964 | V969 | V260 | G977 |
| 8 | R201 | S216 | L776 | S796 | K849 | W911 | L914 | F915 | K917 | A921 | L926 | V206 | G934 |
| 9 | R299 | S314 | L880 | G900 | K953 | W1015 | L1018 | F10T9 | R1021 | A1025 | V1030 | V304 | G1038 |
| 10 | R279 | S294 | L859 | S879 | K932 | W995 | L998 | M999 | K1001 | A1005 | A1010 | V284 | G1018 |
| 11 | R287 | S302 | L865 | G885 | K938 | W1001 | L1004 | F1005 | K1007 | S1011 | L1016 | V292 | G1024 |
| 12 | R200 | S215 | L775 | T795 | K848 | W910 | L913 | F914 | K916 | A920 | M925 | V205 | G933 |
| 13 | R287 | S302 | L865 | G885 | K938 | W1001 | L1004 | F1005 | K1007 | A1011 | L1016 | V292 | G1024 |
| 14 | R290 | S305 | L878 | S898 | K951 | W1013 | L1016 | F1017 | K10T9 | A1023 | V1028 | V295 | G1036 |
| 15 | R282 | S297 | L847 | S867 | K920 | W984 | L987 | F988 | K990 | A994 | V999 | V287 | G1007 |
| 16 | R291 | S306 | L869 | S889 | K942 | W1005 | L1008 | F1009 | K1011 | A1015 | V1020 | V296 | G1028 |
| 17 | R298 | S313 | L886 | S906 | K959 | W1021 | L1024 | F1025 | K1027 | A1031 | V1036 | A303 | G1044 |
| 18 | — | — | L388 | S408 | K461 | W524 | L527 | F528 | K530 | A534 | V539 | — | G547 |
| 19 | R286 | S301 | L875 | S895 | K948 | W1010 | L1013 | F1014 | K1016 | A1020 | V1025 | V291 | G1033 |
| 20 | R293 | S308 | L871 | S891 | K944 | W1007 | L1010 | F1011 | K1013 | A1017 | V1022 | V298 | G1030 |
| 21 | R200 | S215 | L775 | T795 | K848 | W910 | L913 | F914 | K916 | A920 | M925 | V205 | G933 |
| 22 | R298 | S313 | — | — | — | — | — | — | — | — | — | A303 | — |
| 23 | R288 | S303 | L866 | G886 | K939 | W1002 | L1005 | F1006 | K1008 | S1012 | L1017 | V293 | G1025 |
| 24 | R290 | S305 | L868 | S888 | K941 | W1004 | L1007 | F1008 | K1010 | A1014 | V10T9 | V295 | G1027 |
| 25 | R291 | S306 | L881 | S901 | K954 | W1016 | L10T9 | F1020 | K1022 | A1026 | V1031 | V296 | G1039 |
| 26 | R263 | S278 | L826 | G846 | K899 | W961 | L964 | F965 | K967 | S971 | V976 | V268 | G984 |
| 27 | R288 | S303 | L871 | S891 | K944 | W1006 | L1009 | F1010 | R1012 | A1016 | V1021 | V293 | G1029 |
| 28 | R289 | S304 | L871 | S891 | K944 | W1007 | L1010 | F1011 | K1013 | A1017 | I1022 | V294 | G1030 |
| 29 | R224 | S239 | I764 | S784 | R837 | W901 | L904 | L905 | K907 | S911 | T916 | V229 | G924 |
| 30 | RT94 | S209 | L766 | S786 | K839 | W901 | L904 | F905 | K907 | A911 | F916 | VT99 | G924 |
| 31 | R270 | S285 | L832 | G852 | K905 | W967 | L970 | F971 | K973 | S977 | V982 | V275 | G990 |
| 32 | — | — | L760 | G780 | K833 | W894 | L897 | L898 | K900 | S904 | L909 | — | G917 |
| 33 | R237 | S252 | I780 | S800 | K853 | W918 | L921 | L922 | K924 | S928 | V933 | V242 | G941 |
| 34 | R296 | S311 | L876 | S896 | K949 | W1012 | L1015 | F1016 | K1018 | A1022 | A1027 | V301 | G1035 |
| 35 | R296 | S311 | L876 | S896 | K949 | W1012 | L1015 | F1016 | K1018 | A1022 | A1027 | V301 | G1035 |
| 36 | RT95 | S210 | L767 | S787 | K840 | W902 | L905 | F906 | K908 | A912 | F917 | V200 | G925 |
| 37 | R270 | S285 | L832 | G852 | K905 | W967 | L970 | F971 | K973 | S977 | V982 | V275 | G990 |
| 38 | R305 | S320 | L888 | S908 | K961 | W1023 | L1026 | F1027 | R1029 | A1033 | L1038 | V310 | G1046 |
| 39 | R209 | S224 | L780 | S800 | K853 | W915 | L918 | F9T9 | K921 | A925 | F930 | V214 | G938 |
| 40 | R263 | S278 | L826 | G846 | K899 | W961 | L964 | F965 | K967 | S971 | V976 | V268 | G984 |
| 41 | R290 | S305 | L872 | S892 | K945 | W1008 | L1011 | F1012 | K1014 | A1018 | I1023 | V295 | G1031 |
| 42 | RT97 | S212 | L767 | S787 | K840 | W884 | L887 | F888 | K890 | A894 | F899 | V202 | G907 |
| 43 | R305 | S320 | L888 | S908 | K961 | W1023 | L1026 | F1027 | R1029 | A1033 | L1038 | V310 | G1046 |
| 44 | R283 | S298 | L865 | S885 | K938 | W1001 | L1004 | F1005 | K1007 | A1011 | I1016 | V288 | G1024 |
| 45 | R284 | S299 | L866 | S886 | K939 | W1002 | L1005 | F1006 | K1008 | A1012 | I1017 | V289 | G1025 |
| 46 | R306 | S321 | L888 | S908 | K961 | W1023 | L1026 | F1027 | K1029 | A1033 | V1038 | V311 | G1046 |
| 47 | R288 | S303 | L871 | S891 | K944 | W1006 | L1009 | F1010 | R1012 | A1016 | V1021 | V293 | G1029 |
| 48 | R206 | S221 | L781 | T801 | K854 | W916 | F920 | K922 | A926 | M931 | V211 | G939 |
| 49 | R286 | S301 | L865 | S885 | K938 | W1001 | L1004 | F1005 | K1007 | A1011 | V1016 | V291 | G1024 |
| 50 | R295 | S310 | L884 | S904 | K957 | W10T9 | L1022 | F1023 | K1025 | A1029 | V1034 | V300 | G1042 |
| 51 | R289 | S304 | L867 | G887 | K940 | W1003 | L1006 | F1007 | K1009 | S1013 | L1018 | V294 | G1026 |
| 52 | R333 | S348 | L963 | L983 | K1036 | W1101 | L1104 | L1105 | G1107 | S1111 | A1116 | N338 | G1124 |
| 53 | R172 | S187 | L807 | L827 | K880 | Y945 | L948 | L949 | G951 | S955 | A960 | N177 | G968 |
| 54 | R65 | S80 | L639 | G660 | S713 | W789 | L792 | G793 | K795 | A799 | A804 | V70 | G812 |
| 55 | R293 | S308 | L873 | S893 | K946 | W1009 | L1012 | F1013 | K1015 | A10T9 | V1024 | V298 | G1032 |
| 56 | R296 | S311 | L884 | S904 | K957 | W10T9 | L1022 | F1023 | K1025 | A1029 | V1034 | V301 | G1042 |
| 57 | R296 | S311 | L885 | S905 | K958 | W1020 | L1023 | F1024 | K1026 | A1030 | V1035 | V301 | G1043 |
| 58 | R40 | S55 | L629 | S649 | K702 | W764 | L767 | F768 | K770 | A774 | V779 | V45 | G787 |
| 59 | R169 | S184 | L758 | S778 | K831 | W893 | L896 | F897 | K899 | A903 | V908 | V174 | G916 |
| 60 | R314 | S329 | T937 | L957 | K978 | W1043 | F1046 | I1047 | G1049 | S1053 | A1058 | N3T9 | G1066 |
| 61 | R284 | S299 | L846 | S866 | K9T9 | W983 | L986 | F987 | K989 | A993 | V998 | V289 | G1006 |
| 62 | R230 | S245 | I854 | S874 | K927 | W991 | L994 | F995 | K997 | S1001 | L1006 | A235 | G1014 |
| 63 | R284 | S299 | L918 | L938 | K991 | W1056 | L1059 | L1060 | G1062 | S1066 | A1071 | N289 | G1079 |
| 64 | R344 | S359 | L996 | L1016 | K1069 | W1144 | L1147 | L1148 | G1150 | S1154 | C1159 | N349 | G1167 |
| 65 | R291 | S306 | L875 | S895 | K948 | W1010 | L1013 | F1014 | R1016 | A1020 | I1025 | V296 | G1033 |
| 66 | R277 | S292 | L858 | S878 | K931 | W994 | L997 | F998 | K1000 | A1004 | V1009 | V282 | G1017 |
| 67 | R292 | S307 | L877 | S897 | K950 | W1012 | L1015 | F1016 | R1018 | A1022 | I1027 | V297 | G1035 |
| 68 | R287 | S302 | L872 | S892 | K945 | W1007 | L1010 | F1011 | R1013 | A1017 | I1022 | V292 | G1030 |
| 69 | R293 | S308 | L874 | S894 | K947 | W1010 | L1013 | F1014 | R1016 | A1020 | A1025 | V298 | G1033 |
| 70 | R277 | S292 | L858 | S878 | K931 | W994 | L997 | F998 | K1000 | A1004 | V1009 | V282 | G1017 |
| 71 | R291 | S306 | L875 | S895 | K948 | W1010 | L1013 | F1014 | R1016 | A1020 | I1025 | V296 | G1033 |
| 72 | R287 | S302 | L872 | S892 | K945 | W1007 | L1010 | F1011 | R1013 | A1017 | I1022 | V292 | G1030 |
| 73 | R293 | S308 | L874 | S894 | K947 | W1010 | L1013 | F1014 | R1016 | A1020 | A1025 | V298 | G1033 |
| 74 | R277 | S292 | L858 | S878 | K931 | W994 | L997 | F998 | K1000 | A1004 | V1009 | V282 | G1017 |
| 75 | R290 | S305 | L871 | S891 | K944 | W1007 | L1010 | F1011 | K1013 | A1017 | A1022 | V295 | G1030 |
| 76 | R290 | S305 | L871 | S891 | K944 | W1007 | L1010 | F1011 | K1013 | A1017 | A1022 | V295 | G1030 |
| 77 | R277 | S292 | L858 | S878 | K931 | W994 | L997 | F998 | K1000 | A1004 | V1009 | V282 | G1017 |
| 78 | R292 | S307 | L877 | S897 | K950 | W1012 | L1015 | F1016 | R1018 | A1022 | I1027 | V297 | G1035 |

TABLE 2 A-continued

| ID | Pos 1 | Pos 2 | Pos 3 | Pos 4 | Pos 5 | Pos 6 | Pos 7 | Pos 8 | Pos 9 | Pos 10 | Pos 11 | Pos 12 | Pos 13 |
|---|---|---|---|---|---|---|---|---|---|---|---|---|---|
| 79 | R291 | S306 | L870 | S890 | K943 | W1006 | L1009 | F1010 | K1012 | A1016 | V1021 | V296 | G1029 |
| 80 | R290 | S305 | L873 | S893 | K946 | W1009 | L1012 | F1013 | K1015 | A10T9 | V1024 | V295 | G1032 |
| 81 | R271 | S286 | L833 | S853 | K906 | W968 | L971 | F972 | K974 | A978 | L983 | V276 | G991 |
| 82 | R130 | S145 | L713 | S733 | — | — | — | — | — | — | — | V135 | — |
| 83 | — | — | L401 | S421 | K474 | — | — | — | — | — | — | — | — |

TABLE 2

| BID | Pos 1 | Pos 2 | Pos 3 | Pos 4 | Pos 5 |
|---|---|---|---|---|---|
| 1 | Y999 | A1051 | I1053 | F1054 | L1056 |
| 2 | D1002 | A1054 | I1056 | L1057 | L1059 |
| 3 | Y984 | A1036 | I1038 | F1039 | L1041 |
| 4 | D968 | A1020 | I1022 | F1023 | L1025 |
| 5 | D988 | A1040 | I1042 | L1043 | L1045 |
| 6 | D1003 | A1055 | I1057 | L1058 | L1060 |
| 7 | D945 | A997 | I999 | F1000 | L1002 |
| 8 | D902 | A954 | V956 | F957 | L959 |
| 9 | D1006 | A1058 | I1060 | L1061 | L1063 |
| 10 | Y986 | A1038 | I1040 | F1041 | L1043 |
| 11 | Y992 | A1044 | I1046 | F1047 | L1049 |
| 12 | A901 | A953 | V955 | F956 | L958 |
| 13 | Y992 | A1044 | I1046 | F1047 | L1049 |
| 14 | N1004 | A1056 | I1058 | F1059 | L1061 |
| 15 | D975 | A1027 | I1029 | F1030 | L1032 |
| 16 | Y996 | A1048 | I1050 | F1051 | L1053 |
| 17 | N1012 | A1064 | I1066 | F1067 | L1069 |
| 18 | Y515 | A567 | I569 | F570 | L572 |
| 19 | N1001 | A1053 | I1055 | F1056 | L1058 |
| 20 | Y998 | A1050 | I1052 | F1053 | L1055 |
| 21 | A901 | A953 | V955 | F956 | L958 |
| 22 | — | — | — | — | — |
| 23 | Y993 | A1045 | I1047 | F1048 | L1050 |
| 24 | Y995 | A1047 | I1049 | F1050 | L1052 |
| 25 | N1007 | A1059 | I1061 | F1062 | L1064 |
| 26 | D952 | A1004 | I1006 | F1007 | L1009 |
| 27 | D997 | S1049 | I1051 | L1052 | L1054 |
| 28 | Y998 | A1050 | I1052 | F1053 | L1055 |
| 29 | D892 | A944 | I946 | F947 | L949 |
| 30 | D892 | A944 | V946 | F947 | L949 |
| 31 | D958 | A1010 | I1012 | F1013 | L1015 |
| 32 | Y885 | A937 | F939 | F940 | V942 |
| 33 | D909 | A961 | I963 | F964 | L966 |
| 34 | Y1003 | A1055 | I1057 | F1058 | L1060 |
| 35 | Y1003 | A1055 | I1057 | F1058 | L1060 |
| 36 | D893 | A945 | V947 | F948 | L950 |
| 37 | D958 | A1010 | I1012 | F1013 | L1015 |
| 38 | D1014 | A1066 | I1068 | L1069 | L1071 |
| 39 | D906 | A958 | V960 | F961 | L963 |
| 40 | D952 | A1004 | I1006 | F1007 | L1009 |
| 41 | Y999 | A1051 | I1053 | F1054 | L1056 |
| 42 | D875 | A927 | V929 | F930 | L932 |
| 43 | D1014 | A1066 | I1068 | L1069 | L1071 |
| 44 | Y992 | A1044 | I1046 | F1047 | L1049 |
| 45 | Y993 | A1045 | I1047 | F1048 | L1050 |
| 46 | D1014 | A1066 | I1068 | F1069 | L1071 |
| 47 | D997 | A1049 | I1051 | L1052 | L1054 |
| 48 | D907 | A959 | V961 | F962 | L964 |
| 49 | Y992 | A1044 | I1046 | F1047 | L1049 |
| 50 | N1010 | A1062 | I1064 | F1065 | L1067 |
| 51 | Y994 | A1046 | I1048 | F1049 | L1051 |
| 52 | R1092 | A1144 | T1146 | I1147 | L1149 |
| 53 | R936 | S988 | T990 | V991 | L993 |
| 54 | Y779 | V833 | V835 | A836 | L838 |
| 55 | Y1000 | A1052 | I1054 | F1055 | L1057 |
| 56 | N1010 | A1062 | I1064 | F1065 | L1067 |
| 57 | N1011 | A1063 | I1065 | F1066 | L1068 |
| 58 | N755 | A807 | I809 | F810 | L812 |
| 59 | N884 | A936 | I938 | F939 | L941 |
| 60 | R1034 | S1086 | I1088 | V1089 | L1091 |
| 61 | D974 | A1026 | I1028 | F1029 | L1031 |
| 62 | D982 | A1034 | I1036 | F1037 | L1039 |
| 63 | R1047 | A1099 | T1101 | I1102 | L1104 |
| 64 | R1135 | S1187 | I1189 | I1190 | L1192 |
| 65 | D1001 | A1053 | I1055 | L1056 | L1058 |
| 66 | Y985 | A1037 | I1039 | F1040 | L1042 |
| 67 | D1003 | A1055 | I1057 | L1058 | L1060 |
| 68 | D998 | A1050 | I1052 | L1053 | L1055 |
| 69 | Y1001 | A1053 | I1055 | F1056 | L1058 |
| 70 | Y985 | A1037 | I1039 | F1040 | L1042 |
| 71 | D1001 | A1053 | I1055 | L1056 | L1058 |
| 72 | D998 | A1050 | I1052 | L1053 | L1055 |
| 73 | Y1001 | A1053 | I1055 | F1056 | L1058 |
| 74 | Y985 | A1037 | I1039 | F1040 | L1042 |
| 75 | Y998 | A1050 | I1052 | F1053 | L1055 |
| 76 | Y998 | A1050 | I1052 | F1053 | L1055 |
| 77 | Y985 | A1037 | I1039 | F1040 | L1042 |
| 78 | D1003 | A1055 | I1057 | L1058 | L1060 |
| 79 | T997 | A1049 | I1051 | F1052 | L1054 |
| 80 | Y1000 | A1052 | I1054 | F1055 | L1057 |
| 81 | D959 | A1011 | I1013 | F1014 | L1016 |
| 82 | — | — | — | — | — |
| 83 | — | — | — | — | — |

In another embodiment, the variant or derivative of the CESA polypeptide refers to a CESA polypeptide comprising SEQ ID NO: 1, a orthologue, paralogue, or homologue thereof, wherein the amino acid sequence differs from the wildtype amino acid sequence of a CESA polypeptide at one or more positions corresponding to the following positions of SEQ ID NO:1:

832, 840, 842, 843, 885, 928, 930, 957, 982.

Examples of differences at these amino acid positions include, but are not limited to, one or more of the following:
  the amino acid at or corresponding to position 832 is other than serine;
  the amino acid at or corresponding to position 840 is other than glycine;
  the amino acid at or corresponding to position 842 is other than histidine;
  the amino acid at or corresponding to position 843 is other than glycine,
  the amino acid at or corresponding to position 885 is other than proline,
  the amino acid at or corresponding to position 928 is other than valine,
  the amino acid at or corresponding to position 930, is other than glycine;
  the amino acid at or corresponding to position 957 is other than threonine;
  the amino acid at or corresponding to position 982 is other than proline;

In some embodiments, the mutated CESA enzyme comprising SEQ ID NO: 1, a orthologue, paralogue, or homologue thereof, comprises one or more of the following:
  the amino acid at or corresponding to position 832 is Ala, Arg, Asn, Asp, Cys, Gln, Glu, Gly, His, He, Leu, Lys, Met, Phe, Pro, Thr, Trp, Tyr, or Val
  the amino acid at or corresponding to position 840 is Ala, Arg, Asn, Asp, Cys, Gln, Glu, His, He, Leu, Lys, Met, Phe, Pro, Ser, Thr, Trp, Tyr, or Val the amino acid at or corresponding to position 842 is Ala, Arg, Asn, Asp, Cys, Gln, Glu, Gly, He, Leu, Lys, Met, Phe, Pro, Ser, Thr, Trp, Tyr, or Val the amino acid at or corresponding to position 843 is Ala, Arg, Asn, Asp, Cys, Gln, Glu, His, He, Leu, Lys, Met, Phe, Pro, Ser, Thr, Trp, Tyr, or Val the amino acid at or corresponding to position 885 is Ala, Arg, Asn, Asp, Cys, Gln, Glu, Gly, His, He, Leu, Lys, Met, Phe, Ser, Thr, Trp, Tyr, or Val the amino acid at or corresponding to position 928 is Ala, Arg, Asn, Asp, Cys, Gln, Glu, Gly, His, He, Leu, Lys, Met, Phe, Pro, Ser, Thr, Trp, or Tyr, the amino acid at or corresponding to position 930, is Ala, Arg, Asn, Asp, Cys, Gln, Glu, His, He, Leu, Lys, Met, Phe, Pro, Ser, Thr, Trp, Tyr, or Val the amino acid at or corresponding to position 957 is Ala, Arg, Asn, Asp, Cys, Gln, Glu, Gly, His, He, Leu, Lys, Met, Phe, Pro, Ser, Trp, Tyr, or Val the amino acid at or corresponding to position 982 is Ala, Arg, Asn, Asp, Cys, Gln, Glu, Gly, His, He, Leu, Lys, Met, Phe, Ser, Thr, Trp, Tyr, or Val In a preferred embodiment, the amino acid at or corresponding to position 832 of SEQ ID NO: 1 is Asn, In another preferred embodiment, the amino acid at or corresponding to position 840 of SEQ ID NO: 1 is Asp, In another preferred embodiment, the amino acid at or corresponding to position 842 of SEQ ID NO: 1 is Glu, In another preferred embodiment, the amino acid at or corresponding to position 843 of SEQ ID NO: 1 is Glu, In another preferred embodiment, the amino acid at or corresponding to position 885 of SEQ ID NO: 1 Ser, In another preferred embodiment, the amino acid at or corresponding to position 928 of SEQ ID NO: 1 is He, In another preferred embodiment, the amino acid at or corresponding to position 930 of SEQ ID NO: 1 is Asp, In another preferred embodiment, the amino acid at or corresponding to position 957 of SEQ ID NO: 1 is He, In another preferred embodiment, the amino acid at or corresponding to position 982 of SEQ ID NO: 1 is Ser, In another embodiment, the variant or derivative of the CESA polypeptide refers to a CESA polypeptide comprising SEQ ID NO: 51, a orthologue, paralogue, or homologue thereof, wherein the amino acid sequence differs from the wildtype amino acid sequence of a CESA polypeptide at or corresponding to the position 1066 of SEQ ID NO:51.

Examples of differences at these amino acid positions include, but are not limited to, one or more of the following:
the amino acid at or corresponding to position 1066 of SEQ ID NO:51 is other than alanine;

In some embodiments, the mutated CESA enzyme comprising SEQ ID NO:51, a orthologue, paralogue, or homologue thereof, comprises one or more of the following the amino acid at or corresponding to position 1066 is Val, Arg, Asn, Asp, Cys, Gln, Glu, Gly, His, He, Leu, Lys, Met, Phe, Pro, Ser, Thr, Trp, or Tyr.

In a particularly preferred embodiment, the amino acid at or corresponding to position 1066 of SEQ ID NO:51 is Thr.

In another embodiment, the variant or derivative of the CESA polypeptide refers to a CESA polypeptide comprising SEQ ID NO: 55, a orthologue, paralogue, or homologue thereof, wherein the amino acid sequence differs from the wildtype amino acid sequence of a CESA polypeptide at or corresponding to the position 1022 of SEQ ID NO:55.

Examples of differences at these amino acid positions include, but are not limited to, one or more of the following:
the amino acid at or corresponding to position 1022 of SEQ ID NO:55 is other than valine;

In some embodiments, the mutated CESA enzyme comprising SEQ ID NO:55, a orthologue, paralogue, or homologue thereof, comprises one or more of the following the amino acid at or corresponding to position 1022 is Ala, Arg, Asn, Asp, Cys, Gln, Glu, Gly, His, He, Leu, Lys, Met, Phe, Pro, Ser, Thr, Trp, or Tyr.

In a particularly preferred embodiment, the amino acid at or corresponding to position 1022 of SEQ ID NO:55 is Leu.

Table 2C provide an overview of positions in the orthologues and homologues to SEQ ID NO:1, i.e. the corresponding positions in SEQ ID NOs: 1 to 83.

| ID | Pos 1 | Pos 2 | Pos 3 | Pos 4 | Pos 5 | Pos 6 | Pos 7 | Pos 8 | Pos 9 | Pos 10 | Pos 11 |
|---|---|---|---|---|---|---|---|---|---|---|---|
| 1 | S832 | G840 | H842 | G843 | P885 | V928 | G930 | T957 | P982 | N1072 | V1021 |
| 2 | S836 | G844 | G846 | G847 | P889 | V932 | G934 | T961 | P985 | G1072 | V1024 |
| 3 | S817 | G825 | N827 | G828 | P870 | V913 | G915 | T942 | P967 | G1055 | V1006 |
| 4 | S800 | A808 | G810 | G811 | P853 | V896 | G898 | T925 | P951 | G1039 | V990 |
| 5 | S822 | G830 | G832 | G833 | P875 | V918 | G920 | T947 | P971 | G1058 | V1010 |
| 6 | S837 | G845 | G847 | G848 | P890 | V933 | G935 | T962 | P986 | G1073 | V1025 |
| 7 | S778 | G786 | G789 | G790 | P832 | V875 | G877 | T904 | P928 | G1016 | V967 |
| 8 | S735 | G743 | G746 | G747 | P789 | V832 | G834 | T861 | P885 | T974 | V924 |
| 9 | S840 | G848 | G850 | G851 | P893 | V936 | G938 | T965 | P989 | G1076 | V1028 |
| 10 | S8T9 | G827 | N829 | G830 | P872 | V915 | G917 | T944 | P969 | N1060 | V1008 |
| 11 | S825 | G833 | N835 | G836 | P878 | V921 | G923 | T950 | P975 | A1064 | V1014 |
| 12 | S734 | G742 | G745 | G746 | P788 | V831 | G833 | T860 | P884 | T972 | V923 |
| 13 | S825 | G833 | N835 | G836 | P878 | V921 | G923 | T950 | P975 | A1064 | V1014 |
| 14 | S838 | G846 | G848 | G849 | P891 | V934 | G936 | T963 | P987 | G1075 | V1026 |
| 15 | S806 | G814 | N817 | G818 | P860 | V903 | G905 | T932 | P958 | G1046 | V997 |
| 16 | S829 | G837 | G839 | G840 | P882 | V925 | G927 | T954 | P979 | G1067 | V1018 |
| 17 | S846 | G854 | G856 | G857 | P899 | V942 | G944 | T971 | P995 | G1083 | V1034 |
| 18 | S348 | G356 | G358 | G359 | P401 | V444 | G446 | T473 | P498 | G586 | V537 |
| T9 | S835 | G843 | G845 | G846 | P888 | V931 | G933 | T960 | P984 | G1072 | V1023 |
| 20 | S831 | G839 | G841 | G842 | P884 | V927 | G929 | T956 | P981 | G1069 | V1020 |
| 21 | S734 | G742 | G745 | G746 | P788 | V831 | G833 | T860 | P884 | T972 | V923 |
| 22 | — | — | — | — | — | — | — | — | — | — | — |
| 23 | S826 | G834 | N836 | G837 | P879 | V922 | G924 | T951 | P976 | A1065 | V1015 |
| 24 | S828 | G836 | G838 | G839 | P881 | V924 | G926 | T953 | P978 | G1066 | V1017 |
| 25 | S841 | G849 | G851 | G852 | P894 | V937 | G939 | T966 | P990 | G1078 | V1029 |
| 26 | S785 | G793 | E796 | G797 | P839 | V882 | G884 | T911 | P935 | G1023 | V974 |
| 27 | S831 | G839 | G841 | G842 | P884 | V927 | G929 | T956 | P980 | D1067 | V10T9 |
| 28 | S831 | G839 | G841 | G842 | P884 | V927 | G929 | T956 | P981 | G1069 | V1020 |
| 29 | S726 | — | G734 | G735 | P777 | V820 | G822 | V851 | P875 | G963 | V914 |

| ID | Pos 1 | Pos 2 | Pos 3 | Pos 4 | Pos 5 | Pos 6 | Pos 7 | Pos 8 | Pos 9 | Pos 10 | Pos 11 |
|---|---|---|---|---|---|---|---|---|---|---|---|
| 30 | S725 | G733 | G736 | G737 | P779 | V822 | G824 | T851 | P875 | A964 | V914 |
| 31 | S791 | G799 | E802 | K803 | P845 | V888 | G890 | T917 | P941 | G1029 | V980 |
| 32 | S720 | G728 | G730 | G731 | P773 | V816 | G818 | A845 | P868 | G956 | V907 |
| 33 | S739 | G747 | G750 | G751 | P793 | V836 | G838 | V868 | P892 | G980 | V931 |
| 34 | S836 | G844 | N846 | G847 | P889 | V932 | G934 | T961 | P986 | K1074 | V1025 |
| 35 | S836 | G844 | N846 | G847 | P889 | V932 | G934 | T961 | P986 | K1074 | V1025 |
| 36 | S726 | G734 | G737 | G738 | P780 | V823 | G825 | T852 | P876 | A965 | V915 |
| 37 | S791 | G799 | E802 | K803 | P845 | V888 | G890 | T917 | P941 | G1029 | V980 |
| 38 | S848 | G856 | G858 | G859 | P901 | V944 | G946 | T973 | P997 | G1084 | V1036 |
| 39 | S739 | G747 | G750 | G751 | P793 | V836 | G838 | T865 | P889 | E978 | V928 |
| 40 | S785 | G793 | E796 | G797 | P839 | V882 | G884 | T911 | P935 | G1023 | V974 |
| 41 | S832 | G840 | G842 | G843 | P885 | V928 | G930 | T957 | P982 | G1070 | V1021 |
| 42 | S726 | G734 | G737 | G738 | P780 | V823 | G825 | — | P858 | E947 | V897 |
| 43 | S848 | G856 | G858 | G859 | P901 | V944 | G946 | T973 | P997 | G1084 | V1036 |
| 44 | S825 | G833 | S835 | G836 | P878 | V921 | G923 | T950 | P975 | G1063 | V1014 |
| 45 | S826 | G834 | S836 | G837 | P879 | V922 | G924 | T951 | P976 | G1064 | V1015 |
| 46 | S848 | G856 | G858 | C859 | P901 | V944 | G946 | T973 | P997 | G1084 | V1036 |
| 47 | S831 | G839 | G841 | G842 | P884 | V927 | G929 | T956 | P980 | D1067 | V10T9 |
| 48 | S740 | G748 | G751 | G752 | P794 | V837 | G839 | I866 | P890 | T978 | V929 |
| 49 | S825 | G833 | S835 | G836 | P878 | V921 | G923 | T950 | P975 | G1063 | V1014 |
| 50 | S844 | G852 | G854 | G855 | P897 | V940 | G942 | T969 | P993 | G1081 | V1032 |
| 51 | S827 | G835 | N837 | G838 | P880 | V923 | G925 | T952 | P977 | A1066 | V1016 |
| 52 | S925 | — | S933 | R934 | R976 | L1019 | G1021 | T1048 | P1075 | G1164 | V1114 |
| 53 | S769 | — | S777 | R778 | A820 | V863 | G865 | T892 | P9T9 | D1002 | V958 |
| 54 | S600 | — | G609 | R610 | P652 | M696 | T698 | E725 | P762 | A852 | V802 |
| 55 | S833 | G841 | G843 | G844 | P886 | V929 | G931 | T958 | P983 | G1071 | V1022 |
| 56 | S844 | G852 | G854 | G855 | P897 | V940 | G942 | T969 | P993 | G1081 | V1032 |
| 57 | S845 | G853 | G855 | G856 | P898 | V941 | G943 | T970 | P994 | G1082 | V1033 |
| 58 | S589 | G597 | G599 | G600 | P642 | V685 | G687 | T714 | P738 | G826 | V777 |
| 59 | S718 | G726 | G728 | G729 | P771 | V814 | G816 | T843 | P867 | G955 | V906 |
| 60 | S899 | — | S907 | R908 | Q950 | — | — | T990 | P1017 | G1105 | V1056 |
| 61 | S805 | G813 | N816 | G817 | P859 | V902 | G904 | T931 | P957 | G1045 | V996 |
| 62 | S814 | A822 | G824 | G825 | P867 | V910 | G912 | T939 | P965 | G1053 | V1004 |
| 63 | S880 | — | S888 | S889 | Q931 | L974 | G976 | T1003 | P1030 | G1121 | V1069 |
| 64 | S958 | — | S966 | P967 | Q1009 | V1052 | G1054 | T1081 | P1118 | E1205 | V1157 |
| 65 | S835 | G843 | G845 | G846 | P888 | V931 | G933 | T960 | P984 | G1071 | V1023 |
| 66 | S818 | G826 | S828 | G829 | P871 | V914 | G916 | T943 | P968 | G1056 | V1007 |
| 67 | S837 | G845 | G847 | G848 | P890 | V933 | G935 | T962 | P986 | G1073 | V1025 |
| 68 | S832 | G840 | G842 | G843 | P885 | V928 | G930 | T957 | P981 | G1068 | V1020 |
| 69 | S834 | G842 | I844 | G845 | P887 | V930 | G932 | T959 | P984 | N1074 | V1023 |
| 70 | S818 | G826 | S828 | G829 | P871 | V914 | G916 | T943 | P968 | G1056 | V1007 |
| 71 | S835 | G843 | G845 | G846 | P888 | V931 | G933 | T960 | P984 | G1071 | V1023 |
| 72 | S832 | G840 | G842 | G843 | P885 | V928 | G930 | T957 | P981 | G1068 | V1020 |
| 73 | S834 | G842 | I844 | G845 | P887 | V930 | G932 | T959 | P984 | N1074 | V1023 |
| 74 | S818 | G826 | S828 | G829 | P871 | V914 | G916 | T943 | P968 | G1056 | V1007 |
| 75 | S831 | G839 | I841 | G842 | P884 | V927 | G929 | T956 | P981 | N1071 | V1020 |
| 76 | S831 | G839 | I841 | G842 | P884 | V927 | G929 | T956 | P981 | N1071 | V1020 |
| 77 | S818 | G826 | S828 | G829 | P871 | V914 | G916 | T943 | P968 | G1056 | V1007 |
| 78 | S837 | G845 | G847 | G848 | P890 | V933 | G935 | T962 | P986 | G1073 | V1025 |
| 79 | S830 | G838 | N840 | G841 | P883 | V926 | G928 | T955 | P980 | D1069 | V10T9 |
| 80 | S833 | G841 | S843 | G844 | P886 | V929 | G931 | T958 | P983 | G1071 | V1022 |
| 81 | S792 | G800 | G803 | G804 | P846 | V889 | G891 | T918 | P942 | G1030 | V981 |
| 82 | S673 | G681 | S683 | G684 | P726 | — | — | — | — | — | — |
| 83 | S361 | G369 | G371 | C372 | P414 | V457 | G459 | T486 | — | — | — |

Another object refers to a method of identifying a nucleotide sequence encoding a mutated CESA which is resistant or tolerant to a CESA-inhibiting herbicide, the method comprising:
a) generating a library of mutated CESA-encoding nucleic acids,
b) screening a population of the resulting mutated CESA-encoding nucleic acids by expressing each of said nucleic acids in a cell or plant and treating said cell or plant with a CESA-inhibiting herbicide,
c) comparing the CESA-inhibiting herbicide-tolerance levels provided by said population of mutated CESA encoding nucleic acids with the CESA-inhibiting herbicide-tolerance level provided by a control CESA-encoding nucleic acid,
d) selecting at least one mutated CESA-encoding nucleic acid that provides a significantly increased level of tolerance to a CESA-inhibiting herbicide as compared to that provided by the control CESA-encoding nucleic acid.

In a preferred embodiment, the mutated CESA-encoding nucleic acid selected in step d) provides at least 2-fold as much resistance or tolerance of a cell or plant to a CESA-inhibiting herbicide as compared to that provided by the control CESA-encoding nucleic acid.

In a further preferred embodiment, the mutated CESA-encoding nucleic acid selected in step d) provides at least 2-fold, at least 5-fold, at least 10-fold, at least 20-fold, at least 50-fold, at least 100-fold, at least 500-fold, as much resistance or tolerance of a cell or plant to a CESA-inhibiting herbicide as compared to that provided by the control CESA-encoding nucleic acid.

The resistance or tolerance can be determined by generating a transgenic plant or host cell, preferably a plant cell, comprising a nucleic acid sequence of the library of step a) and comparing said transgenic plant with a control plant or host cell, preferably a plant cell.

Another object refers to a method of identifying a plant or algae containing a nucleic acid comprising a nucleotide sequence encoding a mutated CESA which is resistant or tolerant to a CESA-inhibiting herbicide, the method comprising:
- a) identifying an effective amount of a CESA-inhibiting herbicide in a culture of plant cells or green algae that leads to death of said cells.
- b) treating said plant cells or green algae with a mutagenizing agent,
- c) contacting said mutagenized cells population with an effective amount of CESA-inhibiting herbicide, identified in a),
- d) selecting at least one cell surviving these test conditions,
- e) PCR-amplification and sequencing of CESA genes from cells selected in d) and comparing such sequences to wild-type CESA gene sequences, respectively.

In a preferred embodiment, said mutagenizing agent is ethylmethanesulfonate (EMS).

Many methods well known to the skilled artisan are available for obtaining suitable candidate nucleic acids for identifying a nucleotide sequence encoding a mutated CESA from a variety of different potential source organisms including microbes, plants, fungi, algae, mixed cultures etc. as well as environmental sources of DNA such as soil. These methods include inter alia the preparation of cDNA or genomic DNA libraries, the use of suitably degenerate oligonucleotide primers, the use of probes based upon known sequences or complementation assays (for example, for growth upon tyrosine) as well as the use of mutagenesis and shuffling in order to provide recombined or shuffled mutated CESA-encoding sequences.

Nucleic acids comprising candidate and control CESA encoding sequences can be expressed in yeast, in a bacterial host strain, in an alga or in a higher plant such as tobacco or *Arabidopsis* and the relative levels of inherent tolerance of the CESA encoding sequences screened according to a visible indicator phenotype of the transformed strain or plant in the presence of different concentrations of the selected CESA-inhibiting herbicide. Dose responses and relative shifts in dose responses associated with these indicator phenotypes (formation of necrosis, growth inhibition, herbicidal effect etc) are conveniently expressed in terms, for example, of GR50 (concentration for 50% reduction of growth) or MIC (minimum inhibitory concentration) values where increases in values correspond to increases in inherent tolerance of the expressed CESA. For example, in a relatively rapid assay system based upon transformation of *Arabidopsis* as described in the Example section (Example 7), each mutated CESA encoding sequence may be expressed, for example, as a DNA sequence under expression control of a suitable promoter and T1 plants can be selected for differential tolerance to selected CESA-inhibiting herbicides, measured by growth.

In another embodiment, candidate nucleic acids are transformed into plant material to generate a transgenic plant, regenerated into morphologically normal fertile plants which are then measured for differential tolerance to selected CESA-inhibiting herbicides as described in the Example section hereinafter. Many suitable methods for transformation using suitable selection markers such as kanamycin, binary vectors such as from *Agrobacterium* and plant regeneration as, for example, from tobacco leaf discs are well known in the art. Optionally, a control population of plants is likewise transformed with a nucleic acid expressing the control CESA. Alternatively, an untransformed dicot plant such as *Arabidopsis* or Tobacco can be used as a control since this, in any case, expresses its own endogenous CESA. The average, and distribution, of herbicide tolerance levels of a range of primary plant transformation events or their progeny to CESA-inhibiting herbicides described supra are evaluated in the normal manner based upon plant damage, meristematic bleaching symptoms etc. at a range of different concentrations of herbicides. These data can be expressed in terms of, for example, GR50 values derived from dose/response curves having "dose" plotted on the x-axis and "percentage kill", "herbicidal effect", "numbers of emerging green plants" etc. plotted on the y-axis where increased GR50 values correspond to increased levels of inherent tolerance of the expressed CESA. Herbicides can suitably be applied pre-emergence or post-emergence.

Another object of the present invention refers to an isolated and or recombinantly produced and/or synthetic nucleic acid encoding a mutated CESA as disclosed SUPRA, wherein the nucleic acid comprises the nucleotide sequence of SEQ ID NO: 84, 85, 86, 87, 88, 89, 90, 91, 92, 93, 94, 95, 96, 97, or 98, or a variant or derivative thereof.

In one embodiment, the nucleic acid is identifiable by a method as defined above.

For the purposes of the invention "recombinant" means with regard for example to a nucleic acid sequence, an expression cassette (=gene construct, nucleic acid construct) or a vector containing the nucleic acid sequence according to the invention or an organism transformed by said nucleic acid sequences, expression cassette or vector according to the invention all those constructions produced by genetic engineering methods in which either
- (a) the nucleic acid sequence comprising the sequence of SEQ ID NO: 84, 85, 86, 87, 88, 89, 90, 91, 92, 93, 94, 95, 96, 97, or 98, or a homolog thereof, or its derivatives or parts thereof; or
- (b) a genetic control sequence functionally linked to the nucleic acid sequence described under (a), for example a 3'- and/or 5'-genetic control sequence such as a promoter or terminator, or
- (c) (a) and (b);

are not found in their natural, genetic environment or have been modified by genetic engineering methods, wherein the modification may by way of example be a substitution, addition, deletion, inversion or insertion of one or more nucleotide residues.

"Natural genetic environment" means the natural genomic or chromosomal locus in the organism of origin or inside the host organism or presence in a genomic library. In the case of a genomic library the natural genetic environment of the nucleic acid sequence is preferably retained at least in part. The environment borders the nucleic acid sequence at least on one side and has a sequence length of at least 50 bp, preferably at least 500 bp, particularly preferably at least 1,000 bp, most particularly preferably at least 5,000 bp. A naturally occurring expression cassette—for example the naturally occurring combination of the natural promoter of the nucleic acid sequence according to the invention with the corresponding gene—turns into a transgenic expression cassette when the latter is modified by unnatural, synthetic ("artificial") methods such as by way of example a mutagenation. Appropriate methods are described by way of example in U.S. Pat. No. 5,565,350 or WO 00/15815

In a preferred embodiment, the encoded mutated CESA is a variant of SEQ ID NO: 1, which includes one or more of the following:

the amino acid at or corresponding to position 292 is Ala, Asn, Asp, Cys, Gln, Glu, Gly, His, He, Leu, Lys, Met, Phe, Pro, Ser, Thr, Trp, Tyr, or Val;

the amino acid at or corresponding to position 307 is Ala, Arg, Asn, Asp, Cys, Gln, Glu, Gly, His, He, Leu, Lys, Met, Phe, Pro, Thr, Trp, Tyr, or Val;

the amino acid at or corresponding to position 872 is Ala, Arg, Asn, Asp, Cys, Gln, Glu, Gly, His, He, Lys, Met, Phe, Pro, Ser, Thr, Trp, Tyr, or Val;

the amino acid at or corresponding to position 892 is Ala, Arg, Asn, Asp, Cys, Gln, Glu, Gly, His, He, Leu, Lys, Met, Phe, Pro, Thr, Trp, Tyr, or Val;

the amino acid at or corresponding to position 945 is Ala, Arg, Asn, Asp, Cys, Gln, Glu, Gly, His, He, Leu, Met, Phe, Pro, Ser, Thr, Trp, Tyr, or Val;

the amino acid at or corresponding to position 1008 is Ala, Arg, Asn, Asp, Cys, Gln, Glu, Gly, His, He, Leu, Lys, Met, Phe, Pro, Ser, Thr, Tyr, or Val;

the amino acid at or corresponding to position 1011 is Ala, Arg, Asn, Asp, Cys, Gln, Glu, Gly, His, He, Lys, Met, Phe, Pro, Ser, Thr, Trp, Tyr, or Val;

the amino acid at or corresponding to position 1012 is Ala, Arg, Asn, Asp, Cys, Gln, Glu, Gly, His, He, Leu, Lys, Met, Pro, Ser, Thr, Trp, Tyr, or Val;

the amino acid at or corresponding to position 1014 is Ala, Arg, Asn, Asp, Cys, Gln, Glu, Gly, His, He, Leu, Met, Phe, Pro, Ser, Thr, Trp, Tyr, or Val;

the amino acid at or corresponding to position 1018 is Arg, Asn, Asp, Cys, Gln, Glu, Gly, His, He, Leu, Lys, Met, Phe, Pro, Ser, Thr, Trp, Tyr, or Val;

the amino acid at or corresponding to position 1023 is Arg, Asn, Asp, Cys, Gln, Glu, Gly, His, He, Leu, Lys, Met, Phe, Pro, Ser, Thr, Trp, Tyr, or Val.

In a preferred embodiment, the amino acid at or corresponding to position 292 of SEQ ID NO: 1 is His.

In another preferred embodiment, the amino acid at or corresponding to position 307 of SEQ ID NO: 1 is Leu, In another preferred embodiment, the amino acid at or corresponding to position 872 of SEQ ID NO: 1 is Phe, In another preferred embodiment, the amino acid at or corresponding to position 892 of SEQ ID NO: 1 is Asn, In another preferred embodiment, the amino acid at or corresponding to position 945 of SEQ ID NO: 1 is Arg, In another preferred embodiment, the amino acid at or corresponding to position 1008 of SEQ ID NO: 1 is Phe or Ala In another preferred embodiment, the amino acid at or corresponding to position 1011 of SEQ ID NO: 1 is Phe or Ala;

In another preferred embodiment, the amino acid at or corresponding to position 1012 of SEQ ID NO: 1 is Leu or Tyr;

In another preferred embodiment, the amino acid at or corresponding to position 1014 of SEQ ID NO: 1 is Arg, or Gln;

In another preferred embodiment, the amino acid at or corresponding to position 1018 of SEQ ID NO: 1 is Val;

In another preferred embodiment, the amino acid at or corresponding to position 1023 of SEQ ID NO: 1 is Thr.

In another preferred embodiment, the encoded mutated CESA is a variant of SEQ ID NO: 1, which includes one or more of the following:

the amino acid at or corresponding to position 832 is Ala, Arg, Asn, Asp, Cys, Gln, Glu, Gly, His, He, Leu, Lys, Met, Phe, Pro, Thr, Trp, Tyr, or Val the amino acid at or corresponding to position 840 is Ala, Arg, Asn, Asp, Cys, Gln, Glu, His, He, Leu, Lys, Met, Phe, Pro, Ser, Thr, Trp, Tyr, or Val the amino acid at or corresponding to position 842 is Ala, Arg, Asn, Asp, Cys, Gln, Glu, Gly, He, Leu, Lys, Met, Phe, Pro, Ser, Thr, Trp, Tyr, or Val the amino acid at or corresponding to position 843 is Ala, Arg, Asn, Asp, Cys, Gln, Glu, His, He, Leu, Lys, Met, Phe, Pro, Ser, Thr, Trp, Tyr, or Val the amino acid at or corresponding to position 885 is Ala, Arg, Asn, Asp, Cys, Gln, Glu, Gly, His, He, Leu, Lys, Met, Phe, Ser, Thr, Trp, Tyr, or Val the amino acid at or corresponding to position 928 is Ala, Arg, Asn, Asp, Cys, Gln, Glu, Gly, His, He, Leu, Lys, Met, Phe, Pro, Ser, Thr, Trp, or Tyr, the amino acid at or corresponding to position 930, is Ala, Arg, Asn, Asp, Cys, Gln, Glu, His, He, Leu, Lys, Met, Phe, Pro, Ser, Thr, Trp, Tyr, or Val the amino acid at or corresponding to position 957 is Ala, Arg, Asn, Asp, Cys, Gln, Glu, Gly, His, He, Leu, Lys, Met, Phe, Pro, Ser, Trp, Tyr, or Val the amino acid at or corresponding to position 982 is Ala, Arg, Asn, Asp, Cys, Gln, Glu, Gly, His, He, Leu, Lys, Met, Phe, Ser, Thr, Trp, Tyr, or Val In a preferred embodiment, the amino acid at or corresponding to position 832 of SEQ ID NO: 1 is Asn, In another preferred embodiment, the amino acid at or corresponding to position 840 of SEQ ID NO: 1 is Asp, In another preferred embodiment, the amino acid at or corresponding to position 842 of SEQ ID NO: 1 is Glu, In another preferred embodiment, the amino acid at or corresponding to position 843 of SEQ ID NO: 1 is Glu, In another preferred embodiment, the amino acid at or corresponding to position 885 of SEQ ID NO: 1 Ser, In another preferred embodiment, the amino acid at or corresponding to position 928 of SEQ ID NO: 1 is He, In another preferred embodiment, the amino acid at or corresponding to position 930 of SEQ ID NO: 1 is Asp, In another preferred embodiment, the amino acid at or corresponding to position 957 of SEQ ID NO: 1 is He, In another preferred embodiment, the amino acid at or corresponding to position 982 of SEQ ID NO: 1 is Ser, In another preferred embodiment, the encoded mutated CESA is a variant of SEQ ID NO: 3, which includes one or more of the following:

the amino acid at or corresponding to position 984 is Ala, Arg, Asn, Asp, Cys, Gln, Glu, Gly, His, He, Leu, Lys, Met, Phe, Pro, Ser, Thr, Trp, or Val the amino acid at or corresponding to position 1036 is Arg, Asn, Asp, Cys, Gln, Glu, Gly, His, He, Leu, Lys, Met, Phe, Pro, Ser, Thr, Trp, Tyr, or Val the amino acid at or corresponding to position 1038 is Ala, Arg, Asn, Asp, Cys, Gln, Glu, Gly, His, Leu, Lys, Met, Phe, Pro, Ser, Thr, Trp, Tyr, or Val the amino acid at or corresponding to position 1039 is Ala, Arg, Asn, Asp, Cys, Gln, Glu, Gly, His, He, Leu, Lys, Met, Pro, Ser, Thr, Trp, Tyr, Val the amino acid at or corresponding to position 1041 is Ala, Arg, Asn, Asp, Cys, Gln, Glu, Gly, His, He, Lys, Met, Phe, Pro, Ser, Thr, Trp, Tyr, Val In a preferred embodiment, the amino acid at or corresponding to position 984 of SEQ ID NO: 3 is Asp, In another preferred embodiment, the amino acid at or corresponding to position 1036 of SEQ ID NO: 3 is Leu or Phe In another preferred embodiment, the amino acid at or corresponding to position 1038 of SEQ ID NO: 3 is Ala, or Phe, In another preferred embodiment, the amino acid at or corresponding to position 1039 of SEQ ID NO: 3 is Leu, In another preferred embodiment, the amino acid at or corresponding to position 1041 of SEQ ID NO: 3 is Ala, or Phe, In other aspects, the present invention encompasses a progeny or a descendant of a CESA-inhibiting herbicides-tolerant plant of the present invention as well as seeds derived from the CESA-inhibiting herbicides-tolerant plants of the invention and cells derived from the CESA-inhibiting herbicides-tolerant plants of the invention.

In some embodiments, the present invention provides a progeny or descendant plant derived from a plant comprising in at least some of its cells a polynucleotide operably linked to a promoter operable in plant cells, the promoter capable of expressing a mutated CESA polypeptide encoded by the polynucleotide, wherein the progeny or descendant plant comprises in at least some of its cells the recombinant polynucleotide operably linked to the promoter, the expression of the mutated CESA polypeptide conferring to the progeny or descendant plant tolerance to the CESA-inhibiting herbicides.

In one embodiment, seeds of the present invention preferably comprise the CESA-inhibiting herbicides-tolerance characteristics of the CESA-inhibiting herbicides-tolerant plant. In other embodiments, a seed is capable of germination into a plant comprising in at least some of its cells a polynucleotide operably linked to a promoter operable in plant cells, the promoter capable of expressing a mutated CESA polypeptide encoded by the polynucleotide, the expression of the mutated CESA polypeptide conferring to the progeny or descendant plant tolerance to the CESA-inhibiting herbicides.

In some embodiments, plant cells of the present invention are capable of regenerating a plant or plant part. In other embodiments, plant cells are not capable of regenerating a plant or plant part. Examples of cells not capable of regenerating a plant include, but are not limited to, endosperm, seed coat (testa & pericarp), and root cap.

In another embodiment, the present invention provides a plant cell of or capable of regenerating a plant comprising in at least some of its cells a polynucleotide operably linked to a promoter operable in plant cells, the promoter capable of expressing a mutated CESA polypeptide encoded by the polynucleotide, the expression of the mutated CESA polypeptide conferring to the plant tolerance to the CESA-inhibiting herbicides, wherein the plant cell comprises the recombinant polynucleotide operably linked to a promoter.

In other embodiments, the present invention provides a plant cell comprising a polynucleotide operably linked to a promoter operable in plant cells, the promoter capable of expressing a mutated CESA polypeptide encoded by the polynucleotide, the expression of the mutated CESA polypeptide conferring to the cell tolerance to the CESA-inhibiting herbicides.

In another embodiment, the invention refers to a plant cell transformed by a nucleic acid encoding a mutated CESA polypeptide according to the present invention or to a plant cell which has been mutated to obtain a plant expressing a nucleic acid encoding a mutated CESA polypeptide according to the present invention, wherein expression of the nucleic acid in the plant cell results in increased resistance or tolerance to a CESA-inhibiting herbicide as compared to a wild type variety of the plant cell. Preferably, the mutated CESA polypeptide encoding nucleic acid comprises a polynucleotide sequence selected from the group consisting of: a) a polynucleotide as shown in SEQ ID NO: 84, 85, 86, 87, 88, 89, 90, 91, 92, 93, 94, 95, 96, 97, or 98, or a variant or derivative thereof; b) a polynucleotide encoding a polypeptide as shown in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, or a variant or derivative thereof; c) a polynucleotide comprising at least 60 consecutive nucleotides of any of a) or b); and d) a polynucleotide complementary to the polynucleotide of any of a) through c).

In some aspects, the present invention provides a plant product prepared from the CESA-inhibiting herbicides-tolerant plants hereof. In some embodiments, examples of plant products include, without limitation, grain, oil, and meal. In one embodiment, a plant product is plant grain (e.g., grain suitable for use as feed or for processing), plant oil (e.g., oil suitable for use as food or biodiesel), or plant meal (e.g., meal suitable for use as feed).

In one embodiment, a plant product prepared from a plant or plant part is provided, wherein the plant or plant part comprises in at least some of its cells a polynucleotide operably linked to a promoter operable in plant cells, the promoter capable of expressing a mutated CESA polypeptide encoded by the polynucleotide, the expression of the mutated CESA polypeptide conferring to the plant or plant part tolerance to the CESA-inhibiting herbicides.

In another embodiment, the invention refers to a method of producing a transgenic plant cell with an increased resistance to a CESA-inhibiting herbicide as compared to a wild type variety of the plant cell comprising, transforming the plant cell with an expression cassette comprising a polynucleotide operably linked to a promoter operable in plant cells, the promoter capable of expressing a mutated CESA polypeptide encoded by the polynucleotide.

In another embodiment, the invention refers to a method of producing a transgenic plant comprising, (a) transforming a plant cell with an expression cassette comprising a polynucleotide operably linked to a promoter operable in plant cells, the promoter capable of expressing a mutated CESA polypeptide encoded by the polynucleotide, and (b) generating a plant with an increased resistance to CESA-inhibiting herbicide from the plant cell.

In some aspects, the present invention provides a method for producing a CESA-inhibiting herbicides-tolerant plant. In one embodiment, the method comprises: regenerating a plant from a plant cell transformed with a polynucleotide operably linked to a promoter operable in plant cells, the promoter capable of expressing a mutated CESA polypeptide encoded by the polynucleotide, the expression of the mutated CESA polypeptide conferring to the plant tolerance to the CESA-inhibiting herbicides.

The term "expression/expressing" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

To obtain the desired effect, i.e. plants that are tolerant or resistant to the CESA-inhibiting herbicide derivative herbicide of the present invention, it will be understood that the at least one nucleic acid is "over-expressed" by methods and means known to the person skilled in the art.

The term "increased expression" or "overexpression" as used herein means any form of expression that is additional to the original wild-type expression level. Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene. If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene. An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Where appropriate, nucleic acid sequences may be optimized for increased expression in a transformed plant. For example, coding sequences that comprise plant-preferred codons for improved expression in a plant can be provided. See, for example, Campbell and Gowri (1990) Plant Physiol., 92: 1-11 for a discussion of host-preferred codon usage. Methods also are known in the art for preparing plant-preferred genes. See, for example, U.S. Pat. Nos. 5,380,831, and 5,436,391, and Murray et al. (1989) Nucleic Acids Res. 17:477-498, herein incorporated by reference.

Consequently, mutated CESA nucleic acids of the invention are provided in expression cassettes for expression in the plant of interest. The cassette will include regulatory sequences operably linked to a mutated CESA nucleic acid sequence of the invention. The term "regulatory element" as used herein refers to a polynucleotide that is capable of regulating the transcription of an operably linked polynucleotide. It includes, but not limited to, promoters, enhancers, introns, 5' UTRs, and 3' UTRs. By "operably linked" is intended a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame. The cassette may additionally contain at least one additional gene to be cotransformed into the organism. Alternatively, the additional gene(s) can be provided on multiple expression cassettes.

Such an expression cassette is provided with a plurality of restriction sites for insertion of the mutated CESA nucleic acid sequence to be under the transcriptional regulation of the regulatory regions. The expression cassette may additionally contain selectable marker genes. The expression cassette of the present invention will include in the 5'-3' direction of transcription, a transcriptional and translational initiation region (i.e., a promoter), a mutated CESA encoding nucleic acid sequence of the invention, and a transcriptional and translational termination region (i.e., termination region) functional in plants. The promoter may be native or analogous, or foreign or heterologous, to the plant host and/or to the mutated CESA nucleic acid sequence of the invention. Additionally, the promoter may be the natural sequence or alternatively a synthetic sequence. Where the promoter is "foreign" or "heterologous" to the plant host, it is intended that the promoter is not found in the native plant into which the promoter is introduced. Where the promoter is "foreign" or "heterologous" to the mutated CESA nucleic acid sequence of the invention, it is intended that the promoter is not the native or naturally occurring promoter for the operably linked mutated CESA nucleic acid sequence of the invention. As used herein, a chimeric gene comprises a coding sequence operably linked to a transcription initiation region that is heterologous to the coding sequence. While it may be preferable to express the mutated CESA nucleic acids of the invention using heterologous promoters, the native promoter sequences may be used. Such constructs would change expression levels of the mutated CESA protein in the plant or plant cell. Thus, the phenotype of the plant or plant cell is altered.

The termination region may be native with the transcriptional initiation region, may be native with the operably linked mutated CESA sequence of interest, may be native with the plant host, or may be derived from another source (i.e., foreign or heterologous to the promoter, the mutated CESA nucleic acid sequence of interest, the plant host, or any combination thereof). Convenient termination regions are available from the Ti-plasmid of *A. tumefaciens*, such as the octopine synthase and nopaline synthase termination regions. See also Guerineau et al. (1991) Mol. Gen. Genet. 262: 141-144; Proudfoot (1991) Cell 64:671-674; Sanfacon et al. (1991) Genes Dev. 5: 141-149; Mogen et al. (1990) Plant Cell 2: 1261-1272; Munroe et al. (1990) Gene 91: 151-158; Ballas et al. (1989) Nucleic Acids Res. 17:7891-7903; and Joshi et al. (1987) Nucleic Acid Res. 15:9627-9639. Where appropriate, the gene(s) may be optimized for increased expression in the transformed plant. That is, the genes can be synthesized using plant-preferred codons for improved expression. See, for example, Campbell and Gowri (1990) Plant Physio). 92: 1-11 for a discussion of host-preferred codon usage. Methods are available in the art for synthesizing plant-preferred genes. See, for example, U.S. Pat. Nos. 5,380,831, and 5,436,391, and Murray et al. (1989) Nucleic Acids Res. 17:477-498, herein incorporated by reference.

While the polynucleotides of the invention may find use as selectable marker genes for plant transformation, the expression cassettes of the invention can include another selectable marker gene for the selection of transformed cells. Selectable marker genes, including those of the present invention, are utilized for the selection of transformed cells or tissues. Marker genes include, but are not limited to, genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). See generally, Yarranton (1992) Curr. Opin. Biotech. 3:506-511; Christophers on et al (1992) Proc. Natl. Acad. ScL USA 89:6314-6318; Yao et al. (1992) Cell 71:63-72; Reznikoff (1992) Mol Microbio) 6:2419-2422; Barkley et al (1980) in The Operon, pp. 177-220; Hu et al (1987) Cell 48:555-566; Brown et al (1987) Cell 49:603-612; Figge et al (1988) Cell 52:713-722; Deuschle et al (1989) Proc. Natl Acad. AcL USA 86:5400-5404; Fuerst et al (1989) Proc. Natl Acad. ScL USA 86:2549-2553; Deuschle et al (1990) Science 248:480-483; Gossen (1993) Ph.D. Thesis, University of Heidelberg; Reines et al (1993) Proc. Natl Acad. ScL USA 90: 1917-1921; Labow et al (1990) Mol Cell Biol 10:3343-3356; Zambretti et al (1992) Proc. Natl Acad. ScL USA 89:3952-3956; Bairn et al (1991) Proc. Natl Acad. ScL USA 88:5072-5076; Wyborski et al (1991) Nucleic Acids Res. 19:4647-4653; Hillenand-Wissman (1989) Topics Mol Struc. Biol 10: 143-162; Degenkolb et al (1991) Antimicrob. Agents Chemother. 35: 1591-1595; Kleinschnidt et al (1988) Biochemistry 27: 1094-1104; Bonin (1993) Ph.D. Thesis, University of Heidelberg; Gossen et al (1992) Proc. Natl Acad. ScL USA 89:5547-5551; Oliva et al (1992) Antimicrob. Agents Chemother. 36:913-919; Hlavka et al (1985) Handbook of Experimental Pharmacology, Vol. 78 (Springer-Verlag, Berlin); Gill et al (1988) Nature 334:721-724. Such disclosures are herein incorporated by reference. The above list of selectable marker genes is not meant to be limiting. Any selectable marker gene can be used in the present invention.

Further, additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. Also, if desired, sequences can be readily modified to avoid predicted hairpin secondary mRNA structures. Nucleotide sequences for enhancing gene expression can also be used in the plant expression vectors. These include, for example, introns of the maize Adh gene Adh1-S intron 1, 2, and 6 (Callis et al. Genes and Development 1: 1183-1200, 1987), and leader sequences, (W-sequence) from the Tobacco Mosaic virus (TMV), Maize Chlorotic Mottle Virus and Alfalfa Mosaic Virus (Gallie et al. Nucleic Acid Res. 15:8693-8711, 1987 and Skuzeski et al. Plant Mol. Biol. 15:65-79, 1990). The first intron from the shrunken-1 locus of maize has been shown to increase expression of genes in chimeric gene constructs. U.S. Pat. Nos. 5,424,412 and 5,593,874 disclose the use of specific introns in gene expression constructs, and Gallie et al. (Plant Physiol. 106:929-939, 1994) also have shown that introns are useful for regulating gene expression on a tissue specific basis. To further enhance or to optimize gene expression, the plant expression vectors of the invention also may contain DNA sequences containing matrix attachment regions (MARS). Plant cells transformed with such modified expression systems, then, may exhibit overexpression or constitutive expression of a nucleotide sequence of the invention.

The invention further provides an isolated recombinant expression vector comprising the expression cassette containing a mutated CESA nucleic acid nucleic acid as described above, wherein expression of the vector in a host cell results in increased tolerance to a CESA-inhibiting herbicide as compared to a wild type variety of the host cell. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., mutated CESA polypeptides, fusion polypeptides, etc.)

Expression vectors may additionally contain 5' leader sequences in the expression construct. Such leader sequences can act to enhance translation. Translation leaders are known in the art and include: picornavirus leaders, for example, EMCV leader (Encephalomyo carditis 5' noncoding region) (Elroy-Stein et al. (1989) PNAS, 86:6126-6130); potyvirus leaders, for example, TEV leader (Tobacco Etch Virus) (Gallie et al. (1995) Gene 165(2):233-238), MDMV leader (Maize Dwarf Mosaic Virus) (Virology 154:9-20), and human immunoglobulin heavy-chain binding protein (BiP) (Macejak et al. (1991) Nature 353:90-94); untranslated leader from the coat protein mRNA of alfalfa mosaic virus (AMV RNA 4) (Jobling et al. (1987) Nature 325:622-625); tobacco mosaic virus leader (TMV) (Gallie et al.

(1989) in Molecular Biology of RNA, ed. Cech (Liss, New York), pp. 237-256); and maize chlorotic mottle virus leader (MCMV) (Lommel et al. (1991) Virology 81:382-385). See also, Della-Cioppa et al. (1987) Plant Physiol. 84:965-968.

Other methods known to enhance translation also can be utilized, for example, introns, and the like. In preparing an expression vector, the various nucleic acid fragments may be manipulated, so as to provide for the nucleic acid sequences in the proper orientation and, as appropriate, in the proper reading frame. Toward this end, adapters or linkers may be employed to join the nucleic acid fragments or other manipulations may be involved to provide for convenient restriction sites, removal of superfluous nucleic acid, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, tissue-preferred, or other promoters for expression in plants.

Constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) Nature 313:810-812); rice actin (McElroy et al. (1990) Plant Cell 2: 163-171); ubiquitin (Christensen et al. (1989) Plant Mol. Biol. 12:619-632 and Christensen et al. (1992) Plant Mol. Biol. 18:675-689); pEMU (Last et al. (1991) Theor. Appl. Genet. 81:581-588); MAS (Velten et al. (1984) EMBO J. 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

Tissue-preferred promoters can be utilized to target enhanced expression within a particular plant tissue. Such tissue-preferred promoters include, but are not limited to, leaf-preferred promoters, root-preferred promoters, seed-preferred promoters, and stem-preferred promoters. Some examples of tissue-preferred promoters are described by, e.g., Yamamoto et al. (1997) Plant J. 12(2):255-265; Kawamata et al. (1997) Plant Cell Physiol. 38(7):792-803; Hansen et al. (1997) Mol. Gen Genet. 254(3):337-343; Russell et al. (1997) Transgenic Res. 6(2): 157-168; Rinehart et al. (1996) Plant Physiol. 112(3): 1331-1341; Van Camp et al. (1996) Plant Physiol. 112(2):525-535; Canevascini et al. (1996) Plant Physiol. 112(2):513-524; Yamamoto et al. (1994) Plant Cell Physiol. 35(5):773-778; Lam (1994) Results Probl. Cell Differ. 20:181-196; Orozco et al. (1993) Plant Mol Biol. 23(6): 1129-1138; Matsuoka et al. (1993) Voc Natl. Acad. ScL USA 90(20):9586-9590; and Guevara-Garcia et al. (1993) Plant J 4(3):495-505. Promoters can be modified, if necessary, for weak expression.

In some embodiments, the nucleic acids of interest can be targeted to the chloroplast for expression. In this manner, where the nucleic acid of interest is not directly inserted into the chloroplast, the expression vector will additionally contain a chloroplast-targeting sequence comprising a nucleotide sequence that encodes a chloroplast transit peptide to direct the gene product of interest to the chloroplasts. Such transit peptides are known in the art. With respect to chloroplast-targeting sequences, "operably linked" means that the nucleic acid sequence encoding a transit peptide (i.e., the chloroplast-targeting sequence) is linked to the desired coding sequence of the invention such that the two sequences are contiguous and in the same reading frame. See, for example, Von Heijne et al. (1991) Plant Mol. Biol. Rep. 9: 104-126; Clark et al. (1989) J Biol. Chem. 264: 17544-17550; Della-Cioppa et al. (1987) Plant Physiol. 84:965-968; Romer et al. (1993) Biochem. Biophys. Res. Commun. 196: 1414-1421; and Shah et al. (1986) Science 233:478-481. For example, a chloroplast transit peptide known in the art can be fused to the amino acid sequence of a CESA polypeptide of the invention by operably linking a chloroplast-targeting sequence to the 5'-end of a nucleotide sequence encoding the CESA polypeptide.

Chloroplast targeting sequences are known in the art and include the chloroplast small subunit of ribulose-1,5-bisphosphate carboxylase (Rubisco) (de Castro Silva Filho et al. (1996) Plant Mol. Biol. 30:769-780; Schnell et al. (1991) J Biol. Chem. 266(5):3335-3342); EPSPS (Archer et al. (1990) J Bioenerg. Biomemb. 22(6):789-810); tryptophan synthase (Zhao et al. (1995) J Biol. Chem. 270(11):6081-6087); plastocyanin (Lawrence et al. (1997) J Biol. Chem. 272(33):20357-20363); chorismate synthase (Schmidt et al. (1993) J Biol. Chem. 268(36):27447-27457); and the light harvesting chlorophyll a/b binding protein (LHBP) (Lamppa et al. (1988) J Biol. Chem. 263: 14996-14999). See also Von Heine et al. (1991) Plant Mol. Biol. Rep. 9: 104-126; Clark et al. (1989) J Biol. Chem. 264: 17544-17550; Della-Cioppa et al. (1987) Plant Physiol. 84:965-968; Romer et al. (1993) Biochem Biophys. Res. Commun. 196: 1414-1421; and Shah et al. (1986) Science 233:478-481.

Methods for transformation of chloroplasts are known in the art. See, for example, Svab et al. (1990) Proc. Natl. Acad. ScL USA 87:8526-8530; Svab and Maliga (1993) Proc. Natl. Acad. Sci. USA 90:913-917; Svab and Maliga (1993) EMBO J. 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) Proc. Natl. Acad. Sci. USA 91:7301-7305.

The nucleic acids of interest to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

Numerous plant transformation vectors and methods for transforming plants are available. See, for example, An, G. et al. (1986) Plant PysioL, 81:301-305; Fry, J., et al. (1987) Plant Cell Rep. 6:321-325; Block, M. (1988) Theor. Appl. Genet. 16: 161-11A; Hinchee, et al. (1990) Stadler. Genet. Symp. 2032₩2.203-2₩2; Cousins, et al. (1991) Aust. J. Plant Physiol. 18:481-494; Chee, P. P. and Slightom, J. L. (1992) Gene. II 8:255-260; Christou, et al. (1992) Trends. Biotechnol. 10:239-246; Halluin, et al. (1992) Bio/Technol. 10:309-314; Dhir, et al. (1992) Plant Physiol. 99:81-88; Casas et al. (1993) Proc. Nat. Acad Sd. USA 90: 1 1212-1 1216; Christou, P. (1993) In Vitro Cell. Dev. Biol.-Plant; 29P.119-124; Davies, et al. (1993) Plant Cell Rep. 12: 180-183; Dong, J. A. and Mchughen, A. (1993) Plant ScL 91: 139-148; Franklin, C. I. and Trieu, T. N. (1993) Plant. Physiol. 102: 167; Golovkin, et al. (1993) Plant ScL 90:41-52; Guo Chin ScL Bull. 38:2072-2078; Asano, et al. (1994) Plant Cell Rep. 13; Ayeres N. M. and Park, W. D. (1994) Crit. Rev. Plant. Sci. 13:219-239; Barcelo, et al. (1994)

Plant. J. 5:583-592; Becker, et al. (1994) Plant. J. 5:299-307; Borkowska et al. (1994) Acta. Physiol Plant. 16:225-230; Christou, P. (1994) Agro. Food. Ind. Hi Tech. 5: 17-27; Eapen et al. (1994) Plant Cell Rep. 13:582-586; Hartman, et al. (1994) Bio-Technology 12: 919923; Ritala, et al. (1994) Plant. Mol. Biol. 24:317-325; and Wan, Y. C. and Lemaux, P. G. (1994) Plant Physiol. 104:3748.

In some embodiments, the methods of the invention involve introducing a polynucleotide construct into a plant. By "introducing" is intended presenting to the plant the polynucleotide construct in such a manner that the construct gains access to the interior of a cell of the plant. The methods of the invention do not depend on a particular method for introducing a polynucleotide construct to a plant, only that the polynucleotide construct gains access to the interior of at least one cell of the plant. Methods for introducing polynucleotide constructs into plants are known in the art including, but not limited to, stable transformation methods, transient transformation methods, and virus-mediated methods. The term "introduction" or "transformation" as referred to herein further means the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

By "stable transformation" is intended that the polynucleotide construct introduced into a plant integrates into the genome of the plant and is capable of being inherited by descendent thereof. By "transient transformation" is intended that a polynucleotide construct introduced into a plant does not integrate into the genome of the plant.

For the transformation of plants and plant cells, the nucleotide sequences of the invention are inserted using standard techniques into any vector known in the art that is suitable for expression of the nucleotide sequences in a plant or plant cell. The selection of the vector depends on the preferred transformation technique and the target plant species to be transformed. In an embodiment of the invention, the encoding nucleotide sequence is operably linked to a plant promoter, e.g. a promoter known in the art for high-level expression in a plant cell, and this construct is then introduced into a plant cell that is susceptible to CESA-inhibiting herbicides; and a transformed plant is regenerated. In some embodiments, the transformed plant is tolerant to exposure to a level of CESA-inhibiting herbicides that would kill or significantly injure a plant regenerated from an untransformed cell. This method can be applied to any plant species or crops.

Methodologies for constructing plant expression vectors and introducing foreign nucleic acids into plants are generally known in the art. For example, foreign DNA can be introduced into plants, using tumor-inducing (Ti) plasmid vectors. Other methods utilized for foreign DNA delivery involve the use of PEG mediated protoplast transformation, electroporation, microinjection whiskers, and biolistics or microprojectile bombardment for direct DNA uptake. Such methods are known in the art. (U.S. Pat. No. 5,405,765 to Vasil et al.; Bilang et al. (1991) Gene 100: 247-250; Scheid et al., (1991) MoL Gen. Genet., 228: 104-112; Guerche et al., (1987) Plant Science 52: 111-116; Neuhause et al., (1987) Theor. Appl Genet. 75: 30-36; Klein et al., (1987) Nature 327: 70-73; Howell et al., (1980) Science 208: 1265; Horsch et al., (1985) Science 227: 1229-1231; DeBlock et al., (1989) Plant Physiology 91: 694-701; Methods for Plant Molecular Biology (Weissbach and Weissbach, eds.) Academic Press, Inc. (1988) and Methods in Plant Molecular Biology (Schuler and Zielinski, eds.) Academic Press, Inc. (1989).

Other suitable methods of introducing nucleotide sequences into plant cells include microinjection as described by e.g., Crossway et al. (1986) Biotechniques 4:320-334, electroporation as described by e.g., Riggs et al. (1986) Proc. Natl. Acad. ScL USA 83:5602-5606, Agrobacterium-mediated transformation as described by e.g., Townsend et al., U.S. Pat. No. 5,563,055, Zhao et al., U.S. Pat. No. 5,981,840, direct gene transfer as described by, e.g., Paszkowski et al. (1984) EMBO J. 3:2717-2722, and ballistic particle acceleration as described by, e.g., U.S. Pat. Nos. 4,945,050; 5,879,918; 5,886,244; and 5,932,782; Tomes et al. (1995) "Direct DNA Transfer into Intact Plant Cells via Microprojectile Bombardment," in Plant Cell, Tissue, and Organ Culture: Fundamental Methods, ed. Gamborg and Phillips (Springer-Verlag, Berlin); McCabe et al. (1988) Biotechnology 6:923-926); and Led transformation (WO 00/28058). Also see, Weissinger et al., (1988) Ann. Rev. Genet. 22:421-477; Sanford et al, (1987) Particulate Science and Technology 5:27-37 (onion); Christou et al, (1988) Plant Physiol. 87:671-674 (soybean); McCabe et al., (1988) Bio/Technology 6:923-926 (soybean); Finer and McMullen (1991) In Vitro Cell Dev. Biol. 27P: 175-182 (soybean); Singh et al, (1998) Theor. Appl. Genet. 96:319-324 (soybean); Datta et al., (1990) Biotechnology 8:736-740 (rice); Klein et al., (1988) PNAS, 85:4305-4309 (maize); Klein et al., (1988) Biotechnology 6:559-563 (maize); U.S. Pat. Nos. 5,240,855; 5,322,783; and 5,324,646; Tomes et al., (1995) "Direct DNA Transfer into Intact Plant Cells via Microprojectile Bombardment," in Plant Cell, Tissue, and Organ Culture: Fundamental Methods, ed. Gamborg (Springer-Verlag, Berlin) (maize); Klein et al., (1988) Plant Physiol. 91:440-444 (maize); Fromm et al., (1990) Biotechnology 8:833-839 (maize); Hooykaas-Van Slogteren et al., (1984) Nature (London) 311:763-764; Bowen et al, U.S. Pat. No. 5,736,369 (cereals); Bytebier et al, (1987) PNAS 84:5345-5349 (Liliaceae); De Wet et al., (1985) in The Experimental Manipulation of Ovule Tissues, ed. Chapman et al, (Longman, New York), pp. 197-209 (pollen); Kaeppler et al., (1990) Plant Cell Reports 9:415-418 and Kaeppler et al., (1992) Theor. Apph Genet. 84:560-566 (whisker-mediated transformation); D'Halluin et al., (1992) Plant Cell 4: 1495-1505 (electroporation); Li et al., (1993) Plant Cell Reports 12:250-255 and Christou and Ford (1995) Annals of Botany 75:407-413 (rice); Osjoda et al, (1996) Nature Biotechnology 14:745-750 (maize via Agrobacterium tumefaciens); each of which is herein incorporated by reference.

Transgenic plants, including transgenic crop plants, are preferably produced via Agrobacterium-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Cough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physio) 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physio). Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Hofgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

One transformation method known to those of skill in the art is the dipping of a flowering plant into an Agrobacteria solution, wherein the Agrobacteria contains the CESA nucleic acid, followed by breeding of the transformed gametes. *Agrobacterium* mediated plant transformation can be performed using for example the GV3101(pMP90) (Koncz and Schell, 1986, Mol. Gen. Genet. 204:383-396) or LBA4404 (Clontech) *Agrobacterium tumefaciens* strain. Transformation can be performed by standard transformation and regeneration techniques (Deblaere et al., 1994, Nucl. Acids. Res. 13:4777-4788; Gelvin, Stanton B. and Schilperoort, Robert A, Plant Molecular Biology Manual, 2nd Ed.—Dordrecht: Kluwer Academic Publ., 1995.—in Sect., Ringbuc Zentrale Signatur: BT11-P ISBN 0-7923-2731-4; Glick, Bernard R. and Thompson, John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., 1989, Plant Cell Report 8:238-242; De Block et al., 1989, Plant Physio). 91:694-701). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., 1994, Plant Cell Report 13:282-285. Additionally, transformation of soybean can be performed using for example a technique described in European Patent No. 0424 047, U.S. Pat. No. 5,322,783, European Patent No. 0397 687, U.S. Pat. No. 5,376,543, or U.S. Pat. No. 5,169, 770. Transformation of maize can be achieved by particle bombardment, polyethylene glycol mediated DNA uptake, or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

In some embodiments, polynucleotides of the present invention may be introduced into plants by contacting plants with a virus or viral nucleic acids. Generally, such methods involve incorporating a polynucleotide construct of the invention within a viral DNA or RNA molecule. It is recognized that the polypeptides of the invention may be initially synthesized as part of a viral polyprotein, which later may be processed by proteolysis in vivo or in vitro to produce the desired recombinant polypeptide. Further, it is recognized that promoters of the invention also encompass promoters utilized for transcription by viral RNA polymerases. Methods for introducing polynucleotide constructs into plants and expressing a protein encoded therein, involving viral DNA or RNA molecules, are known in the art. See, for example, U.S. Pat. Nos. 5,889,191, 5,889,190, 5,866, 785, 5,589,367 and 5,316,931; herein incorporated by reference. The cells that have been transformed may be grown into plants in accordance with conventional ways. See, for example, McCormick et al. (1986) Plant Cell Reports 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved.

The present invention may be used for transformation of any plant species, including, but not limited to, monocots and dicots. Examples of plant species of interest include, but are not limited to, corn or maize (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet e.g., pearl millet (*Pennisetum glaucum*), proso millet (*Panicum miliaceum*), foxtail millet (*Setaria italica*), finger millet (*Eleusine coracana*)), sunflower (*Helianthus annu*), safflower (*Carthamus tinctorius*), wheat (*Triticum aestivum*, T. Turgidum ssp. *durum*), soybean (*Glycine max*), tobacco (*Nicotiana tabacum*), potato (*Solarium tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus carica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers. Preferably, plants of the present invention are crop plants (for example, sunflower, Brassica sp., cotton, sugar, beet, soybean, peanut, alfalfa, safflower, tobacco, corn, rice, wheat, rye, barley triticale, sorghum, millet, etc.).

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann K (1992). In: C Koncz, N—H Chua and J Shell, Eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Cough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229). The genetically modified plant cells can be regenerated via all methods with which the skilled worker is familiar. Suitable methods can be found in the abovementioned publications by S. D. Kung and R. Wu, Potrykus or Hofgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

Preferably, the expression of the nucleic acid in the plant results in the plant's increased tolerance to CESA-inhibiting herbicide as compared to a wild type variety of the plant.

In another embodiment, the invention refers to a plant, comprising a plant cell according to the present invention, wherein expression of the nucleic acid in the plant results in the plant's increased resistance to CESA-inhibiting herbicide as compared to a wild type variety of the plant.

The plants described herein can be either transgenic crop plants or non-transgenic plants.

In addition to the general definition, give SUPRA, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues in order to allow for the expression of the mutated CESA of the present invention. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein. Furthermore, the term "transgenic" refers to any plant, plant cell, callus, plant tissue, or plant part, that contains all or part of at least one recombinant polynucleotide. In many cases, all or part of the recombinant polynucleotide is stably integrated into a chromosome or stable extra-chromosomal element, so that it is passed on to successive generations. For the purposes of the invention, the term "recombinant polynucleotide" refers to a polynucleotide that has been altered, rearranged, or modified by genetic engineering. Examples include any cloned polynucleotide, or polynucleotides, that are linked or joined to heterologous sequences. The term "recombinant" does not refer to alterations of polynucleotides that result from naturally occurring events, such as spontaneous mutations, or from non-spontaneous mutagenesis followed by selective breeding.

Plants containing mutations arising due to non-spontaneous mutagenesis and selective breeding are referred to herein as non-transgenic plants and are included in the present invention. In embodiments wherein the plant is transgenic and comprises multiple mutated CESA nucleic acids, the nucleic acids can be derived from different genomes or from the same genome. Alternatively, in embodiments wherein the plant is non-transgenic and comprises multiple mutated CESA nucleic acids, the nucleic acids are located on different genomes or on the same genome.

In certain embodiments, the present invention involves herbicide-resistant plants that are produced by mutation breeding. Such plants comprise a polynucleotide encoding a mutated CESA and are tolerant to one or more CESA-inhibiting herbicides. Such methods can involve, for example, exposing the plants or seeds to a mutagen, particularly a chemical mutagen such as, for example, ethyl methanesulfonate (EMS) and selecting for plants that have enhanced tolerance to at least one or more CESA-inhibiting herbicide [see Example 1]. However, the present invention is not limited to herbicide-tolerant plants that are produced by a mutagenesis method involving the chemical mutagen EMS. Any mutagenesis method known in the art may be used to produce the herbicide-resistant plants of the present invention. Such mutagenesis methods can involve, for example, the use of any one or more of the following mutagens: radiation, such as X-rays, Gamma rays (e.g., cobalt 60 or cesium 137), neutrons, (e.g., product of nuclear fission by uranium 235 in an atomic reactor), Beta radiation (e.g., emitted from radioisotopes such as phosphorus 32 or carbon 14), and ultraviolet radiation (preferably from 250 to 290 nm), and chemical mutagens such as base analogues (e.g., 5-bromo-uracil), related compounds (e.g., 8-ethoxy caffeine), antibiotics (e.g., streptonigrin), alkylating agents (e.g., sulfur mustards, nitrogen mustards, epoxides, ethylenamines, sulfates, sulfonates, sulfones, lactones), azide, hydroxylamine, nitrous acid, or acridines. Herbicide-resistant plants can also be produced by using tissue culture methods to select for plant cells comprising herbicide-resistance mutations and then regenerating herbicide-resistant plants therefrom. See, for example, U.S. Pat. Nos. 5,773,702 and 5,859,348, both of which are herein incorporated in their entirety by reference. Further details of mutation breeding can be found in "Principals of Cultivar Development" Fehr, 1993 Macmillan Publishing Company the disclosure of which is incorporated herein by reference Alternatively, herbicide-resistant plants according to the present invention can also be produced by using genome editing methods to select for plant cells comprising herbicide-resistance mutations and then regenerating herbicide-resistant plants therefrom. "Genome Editing" refers to a type of genetic engineering in which DNA is inserted, deleted or replaced in the genome of an organism using engineered nucleases. These nucleases are known to the skilled artisan to create site-specific double-strand breaks at desired locations in the genome. The induced double-strand breaks are repaired through nonhomologous end-joining or homologous recombination, resulting in targeted mutations. Known in the art are currently four families of engineered nucleases which can be used for the puposes of the present invention: meganucleases, zinc finger nucleases (ZFNs), transcription activator-like effector-based nucleases (TALEN), and the CRISPR-Cas system.—For references, see, for example, Esvelt, K M. and Wang, H H. (2013) "Genome-scale engineering for systems and synthetic biology", Mol Syst Biol. 9 (1): 641; Tan, W S. et al., (2012) "Precision editing of large animal genomes", Adv Genet. 80: 37-97; Puchta, H. and Fauser, F. (2013) "Gene targeting in plants: 25 years later", Int. J. Dev. Biol. 57: 629-637; Boglioli, Elsy and Richard, Magali "Rewriting the book of life: a new era in precision genome editing", Boston Consulting Group, Retrieved Nov. 30, 2015; Method of the Year 2011. Nat Meth 9 (1), 1-1.

The plant of the present invention comprises at least one mutated CESA nucleic acid or over-expressed wild-type CESA nucleic acid, and has increased tolerance to a CESA-inhibiting herbicide as compared to a wild-type variety of the plant. It is possible for the plants of the present invention to have multiple mutated CESA nucleic acids from different genomes since these plants can contain more than one genome. For example, a plant contains two genomes, usually referred to as the A and B genomes. Because CESA is a required metabolic enzyme, it is assumed that each genome has at least one gene coding for the CESA enzyme (i.e. at least one CESA gene). As used herein, the term "CESA gene locus" refers to the position of a CESA gene on a genome, and the terms "CESA gene" and "CESA nucleic acid" refer to a nucleic acid encoding the CESA enzyme. The CESA nucleic acid on each genome differs in its nucleotide sequence from a CESA nucleic acid on another genome. One of skill in the art can determine the genome of origin of each CESA nucleic acid through genetic crossing and/or either sequencing methods or exonuclease digestion methods known to those of skill in the art.

The present invention includes plants comprising one, two, three, or more mutated CESA alleles, wherein the plant has increased tolerance to a CESA-inhibiting herbicide as compared to a wild-type variety of the plant. The mutated CESA alleles can comprise a nucleotide sequence selected from the group consisting of a polynucleotide as defined in SEQ ID NO: 84, 85, 86, 87, 88, 89, 90, 91, 92, 93, 94, 95, 96, 97, or 98, or a variant or derivative thereof, a polynucleotide encoding a polypeptide as defined in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82 or 83, or a variant or derivative, homologue, orthologue, paralogue thereof, a polynucleotide comprising at least 60 consecutive nucleotides of any of the aforementioned polynucleotides; and a polynucleotide complementary to any of the aforementioned polynucleotides.

"Alleles" or "allelic variants" are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms The term "variety" refers to a group of plants within a species defined by the sharing of a common set of characteristics or traits accepted by those skilled in the art as sufficient to distinguish one cultivar or variety from another cultivar or variety. There is no implication in either term that all plants of any given cultivar or variety will be genetically identical at either the whole gene or molecular level or that any given plant will be homozygous at all loci. A cultivar or variety is considered "true breeding" for a particular trait if, when the true-breeding cultivar or variety is self-pollinated, all of the progeny contain the trait. The terms "breeding line" or "line" refer to a group of plants within a cultivar defined by the sharing of a common set of characteristics or traits accepted by those skilled in the art as sufficient to distinguish one breeding line or line from another breeding line or line. There is no implication in either term that all plants of any given breeding line or line will be genetically identical at either the whole gene or molecular level or that any given plant will be homozygous at all loci. A breeding line or line is considered "true breeding" for a particular trait if, when the true-breeding line or breeding line is self-pollinated, all of the progeny contain the trait. In the present invention, the trait arises from a mutation in a CESA gene of the plant or seed.

The herbicide-resistant plants of the invention that comprise polynucleotides encoding mutated CESA polypeptides also find use in methods for increasing the herbicide-resistance of a plant through conventional plant breeding involving sexual reproduction. The methods comprise crossing a first plant that is a herbicide-resistant plant of the invention to a second plant that may or may not be resistant to the same herbicide or herbicides as the first plant or may be resistant to different herbicide or herbicides than the first plant. The second plant can be any plant that is capable of producing viable progeny plants (i.e., seeds) when crossed with the first plant. Typically, but not necessarily, the first and second plants are of the same species. The methods can optionally involve selecting for progeny plants that comprise the mutated CESA polypeptides of the first plant and the herbicide resistance characteristics of the second plant. The progeny plants produced by this method of the present invention have increased resistance to a herbicide when compared to either the first or second plant or both. When the first and second plants are resistant to different herbicides, the progeny plants will have the combined herbicide tolerance characteristics of the first and second plants. The methods of the invention can further involve one or more generations of backcrossing the progeny plants of the first cross to a plant of the same line or genotype as either the first or second plant. Alternatively, the progeny of the first cross or any subsequent cross can be crossed to a third plant that is of a different line or genotype than either the first or second plant. The present invention also provides plants, plant organs, plant tissues, plant cells, seeds, and non-human host cells that are transformed with the at least one polynucleotide molecule, expression cassette, or transformation vector of the invention. Such transformed plants, plant organs, plant tissues, plant cells, seeds, and non-human host cells have enhanced tolerance or resistance to at least one herbicide, at levels of the herbicide that kill or inhibit the growth of an untransformed plant, plant tissue, plant cell, or non-human host cell, respectively. Preferably, the transformed plants, plant tissues, plant cells, and seeds of the invention are *Arabidopsis thaliana* and crop plants.

It is to be understood that the plant of the present invention can comprise a wild type CESA nucleic acid in addition to a mutated CESA nucleic acid. It is contemplated that the CESA-inhibiting herbicide tolerant lines may contain a mutation in only one of multiple CESA isoenzymes. Therefore, the present invention includes a plant comprising one or more mutated CESA nucleic acids in addition to one or more wild type CESA nucleic acids.

In another embodiment, the invention refers to a seed produced by a transgenic plant comprising a plant cell of the present invention, wherein the seed is true breeding for an increased resistance to a CESA-inhibiting herbicide as compared to a wild type variety of the seed.

In other aspects, CESA-inhibiting herbicides-tolerant plants of the present invention can be employed as CESA-inhibiting herbicides-tolerance trait donor lines for development, as by traditional plant breeding, to produce other varietal and/or hybrid crops containing such trait or traits. AH such resulting variety or hybrids crops, containing the ancestral CESA-inhibiting herbicides-tolerance trait or traits can be referred to herein as progeny or descendant of the ancestral, CESA-inhibiting herbicides-tolerant line(s).

In other embodiments, the present invention provides a method for producing a CESA-inhibiting herbicides-tolerant plant. The method comprises: crossing a first CESA-inhibiting herbicides-tolerant plant with a second plant to produce a CESA-inhibiting herbicides-tolerant progeny plant, wherein the first plant and the progeny plant comprise in at least some of their cells a polynucleotide operably linked to a promoter operable in plant cells, the recombinant polynucleotide being effective in the cells of the first plant to express a mutated CESA polypeptide encoded by the polynucleotide, the expression of the mutated CESA polypeptide conferring to the plant tolerance to CESA-inhibiting herbicides.

In some embodiments, traditional plant breeding is employed whereby the CESA-inhibiting herbicides-tolerant trait is introduced in the progeny plant resulting therefrom. In one embodiment, the present invention provides a method for producing a CESA-inhibiting herbicides-tolerant progeny plant, the method comprising: crossing a parent plant with a CESA-inhibiting herbicides-tolerant plant to introduce the CESA-inhibiting herbicides-tolerance characteristics of the CESA-inhibiting herbicides-tolerant plant into the germplasm of the progeny plant, wherein the progeny plant has increased tolerance to the CESA-inhibiting herbicides relative to the parent plant. In other embodiments, the method further comprises the step of introgressing the CESA-inhibiting herbicides-tolerance characteristics through traditional plant breeding techniques to obtain a descendent plant having the CESA-inhibiting herbicides-tolerance characteristics.

In other aspects, plants of the invention include those plants which, in addition to being CESA-inhibiting herbicides-tolerant, have been subjected to further genetic modifications by breeding, mutagenesis or genetic engineering, e.g. have been rendered tolerant to applications of specific other classes of herbicides, such as AHAS inhibitors; auxinic herbicides; bleaching herbicides such as hydroxyphenylpyruvate dioxygenase (HPPD) inhibitors or phytoene desaturase (PDS) inhibitors; EPSPS inhibitors such as glyphosate; glutamine synthetase (GS) inhibitors such as glufosinate; lipid biosynthesis inhibitors such as acetyl CoA carboxylase (ACCase) inhibitors; or oxynil {i.e. bromoxynil or ioxynil) herbicides as a result of conventional methods of breeding or genetic engineering, Thus, CESA-inhibiting herbicides-tolerant plants of the invention can be made resistant to multiple classes of herbicides through multiple genetic modifications, such as resistance to both glyphosate and glufosinate or to both glyphosate and a herbicide from another class such as HPPD inhibitors, AHAS inhibitors, or ACCase inhibitors. These herbicide resistance technologies are, for example, described in Pest Management Science (at volume, year, page): 61, 2005, 246; 61, 2005, 258; 61, 2005, 277; 61, 2005, 269; 61, 2005, 286; 64, 2008, 326; 64, 2008, 332; Weed Science 57, 2009, 108; Australian Journal of Agricultural Research 58, 2007, 708; Science 316, 2007, 1185; and references quoted therein. For example, CESA-inhibiting herbicides-tolerant plants of the invention, in some embodiments, may be tolerant to ACCase inhibitors, such as "dims" {e.g., cycloxydim, sethoxydim, clethodim, or tepraloxydim), "fops" {e.g., clodinafop, diclofop, fluazifop, haloxyfop, or quizalofop), and "dens" (such as pinoxaden); to auxinic herbicides, such as dicamba; to EPSPS inhibitors, such as glyphosate; to other CESA inhibitors; and to GS inhibitors, such as glufosinate.

In addition to these classes of inhibitors, CESA-inhibiting herbicides-tolerant plants of the invention may also be tolerant to herbicides having other modes of action, for example, chlorophyll/carotenoid pigment inhibitors, cell membrane disrupters, photosynthesis inhibitors, cell division inhibitors, root inhibitors, shoot inhibitors, and combinations thereof.

Such tolerance traits may be expressed, e.g.: as mutant or wildtype HPPD proteins, as mutant AHASL proteins, mutant ACCase proteins, mutant EPSPS proteins, or mutant glutamine synthetase proteins; or as mutant native, inbred, or transgenic aryloxyalkanoate dioxygenase (AAD or DHT), haloarylnitrilase (BXN), 2,2-dichloropropionic acid dehalogenase (DEH), glyphosate-N-acetyltransferase (GAT), glyphosate decarboxylase (GDC), glyphosate oxidoreductase (GOX), glutathione-S-transferase (GST), phosphinothricin acetyltransferase (PAT or bar), or CYP450s proteins having an herbicide-degrading activity. CESA-inhibiting herbicides-tolerant plants hereof can also be stacked with other traits including, but not limited to, pesticidal traits such as Bt Cry and other proteins having pesticidal activity toward coleopteran, lepidopteran, nematode, or other pests; nutrition or nutraceutical traits such as modified oil content or oil profile traits, high protein or high amino acid concentration traits, and other trait types known in the art.

Furthermore, in other embodiments, CESA-inhibiting herbicides-tolerant plants are also covered which are, by the use of recombinant DNA techniques and/or by breeding and/or otherwise selected for such characteristics, rendered able to synthesize one or more insecticidal proteins, especially those known from the bacterial genus *Bacillus*, particularly from *Bacillus thuringiensis*, such as [delta]-endotoxins, e.g. CryIA(b), CryIA(c), CryIF, CryIF(a2), CryIIA (b), CryIIIA, CryIIIB(b1) or Cry9c; vegetative insecticidal proteins (VIP), e.g. VIP1, VIP2, VIP3 or VIP3A; insecticidal proteins of bacteria colonizing nematodes, e.g. *Photorhabdus* spp. or Xenorhabdus spp.; toxins produced by animals, such as scorpion toxins, arachnid toxins, wasp toxins, or other insect-specific neurotoxins; toxins produced by fungi, such streptomycete toxins; plant lectins, such as pea or barley lectins; agglutinins; proteinase inhibitors, such as trypsin inhibitors, serine protease inhibitors, patatin, cystatin or papain inhibitors; ribosome-inactivating proteins (RIP), such as ricin, maize-RIP, abrin, luffin, saporin or bryodin; steroid metabolism enzymes, such as 3-hydroxysteroid oxidase, ecdysteroid-IDP-glycosyl-transferase, cholesterol oxidases, ecdysone inhibitors or HMG-CoA-reductase; ion channel blockers, such as blockers of sodium or calcium channels; juvenile hormone esterase; diuretic hormone receptors (helicokinin receptors); stilben synthase, bibenzyl synthase, chitinases or glucanases. In the context of the present invention these insecticidal proteins or toxins are to be understood expressly also as pre-toxins, hybrid proteins, truncated or otherwise modified proteins. Hybrid proteins are characterized by a new combination of protein domains, (see, e.g. WO 02/015701). Further examples of such toxins or genetically modified plants capable of synthesizing such toxins are disclosed, e.g., in EP-A 374 753, WO 93/007278, WO 95/34656, EP-A 427 529, EP-A 451 878, WO 03/18810 and WO 03/52073. The methods for producing such genetically modified plants are generally known to the person skilled in the art and are described, e.g. in the publications mentioned above. These insecticidal proteins contained in the genetically modified plants impart to the plants producing these proteins tolerance to harmful pests from all taxonomic groups of arthropods, especially to beetles (*Coeloptera*), two-winged insects (*Diptera*), and moths (*Lepidoptera*) and to nematodes (*Nematoda*).

In some embodiments, expression of one or more protein toxins (e.g., insecticidal proteins) in the CESA-inhibiting herbicides-tolerant plants is effective for controlling organisms that include, for example, members of the classes and orders: Coleoptera such as the American bean weevil *Acanthoscelides obtectus*; the leaf beetle *Agelastica alni*; click beetles (*Agriotes lineatus, Agriotes obscurus, Agriotes bicolor*); the grain beetle *Ahasverus advena*; the summer schafer *Amphimallon solstitialis*; the furniture beetle *Anobium punctatum; Anthonomus* spp. (weevils); the Pygmy mangold beetle *Atomaria linearis*; carpet beetles (*Anthrenus* spp., *Attagenus* spp.); the cowpea weevil *Callosobruchus maculates*; the fried fruit beetle *Carpophilus hemipterus*; the cabbage seedpod weevil *Ceutorhynchus assimilis*; the rape winter stem weevil *Ceutorhynchus picitarsis*; the wireworms *Conoderus vespertinus* and *Conoderus falli*; the banana weevil *Cosmopolites sordidus*; the New Zealand grass grub *Costelytra zealandica*; the June beetle *Cotinis nitida*; the sunflower stem weevil *Cylindrocopturus adspersus*; the larder beetle *Dermestes lardarius*; the corn rootworms *Diabrotica virgifera, Diabrotica virgifera virgifera*, and *Diabrotica barberi*; the Mexican bean beetle *Epilachna varivestis*; the old house borer *Hylotropes bajulus*; the lucerne weevil *Hypera postica*; the shiny spider beetle *Gibbium psylloides*; the cigarette beetle *Lasioderma serricorne*; the Colorado potato beetle *Leptinotarsa decemlineata; Lyctus* beetles {*Lyctus* spp., the pollen beetle *Meligethes aeneus*; the common cockchafer *Melolontha melolontha*; the American spider beetle *Mezium americanum*; the golden spider beetle *Niptus hololeucs*; the grain beetles *Oryzaephilus surinamensis* and *Oryzaephilus mercator*; the black vine weevil *Otiorhynchus sulcatus*; the mustard beetle *Phaedon cochleariae*, the crucifer flea beetle *Phyllotreta cruciferae*; the striped flea beetle *Phyllotreta striolata*; the cabbage steam flea beetle *Psylliodes chrysocephala; Ptinus* spp. (spider beetles); the lesser grain borer *Rhizopertha dominica*; the pea and been weevil *Sitona lineatus*; the rice and granary beetles *Sitophilus oryzae* and *Sitophilus granaries*; the red sunflower seed weevil *Smicronyx fulvus*; the drugstore beetle *Stegobium paniceum*; the yellow mealworm beetle *Tenebrio molitor*, the flour beetles *Tribolium castaneum* and *Tribolium confusum*; warehouse and cabinet beetles {*Trogoderma* spp.); the sunflower beetle *Zygogramma exclamationis; Dermaptera* (earwigs) such as the European earwig *Forficula auricularia* and the striped earwig *Labidura riparia; Dictyoptera* such as the oriental cockroach *Blatta orientalis*; the greenhouse millipede *Oxidus gracilis*; the beet fly *Pegomyia betae*; the frit fly *Oscinella* frit; fruitflies (*Dacus* spp., *Drosophila* spp.); Isoptera (termites) including species from the families Hodotermitidae, Kalotermitidae, Mastotermitidae, Rhinotermitidae, Serritermitidae, Termitidae, Termopsidae; the tarnished plant bug *Lygus lineolaris*; the black bean aphid *Aphis fabae*; the cotton or melon aphid *Aphis gossypii*; the green apple aphid *Aphis pomi*; the citrus spiny whitefly *Aleurocanthus spiniferus*; the sweet potato whitefly *Bemesia tabaci*; the cabbage aphid *Brevicoryne brassicae*; the pear psylla *Cacopsylla pyricola*; the currant aphid *Cryptomyzus ribis*; the grape phylloxera *Daktulosphaira vitifoliae*; the citrus psylla *Diaphorina citri*; the potato leafhopper *Empoasca fabae*; the bean leafhopper *Empoasca* Solana; the vine leafhopper *Empoasca vitis*; the woolly aphid *Eriosoma lanigerum*; the European fruit scale *Eulecanium corni*; the mealy plum aphid *Hyalopterus arundinis*; the small brown planthopper *Laodelphax striatellus*; the potato aphid *Macrosiphum euphorbiae*; the green peach aphid *Myzus persicae*; the green rice leafhopper *Nephotettix cinticeps*; the brown planthopper *Nilaparvata lugens*; the hop aphid *Phorodon humuli*; the bird-cherry aphid *Rhopalosiphum padi*; the grain aphid *Sitobion avenae; Lepidoptera* such as *Adoxophyes orana* (summer fruit tortrix moth); *Archips podana* (fruit tree tortrix moth); *Bucculatrix pyrivorella* (pear leafminer); *Bucculatrix thurberiella* (cotton leaf perforator); *Bupalus piniarius* (pine looper); *Carpocapsa pomonella* (codling moth); *Chilo suppressalis* (striped rice borer); *Choristoneura fumiferana* (eastern spruce budworm); *Cochylis hospes* (banded sunflower moth); *Diatraea grandiosella* (southwestern corn borer); *Eupoecilia ambiguella* (European grape berry moth); *Helicoverpa armigera* (cotton bollworm); *Helicoverpa zea* (cotton bollworm); *Heliothis virescens* (tobacco budworm), *Homoeosoma electellum* (sunflower moth); *Homona magnanima* (oriental tea tree tortrix moth); *Lithocolletis blancardella* (spotted tentiform leafminer); *Lymantria dispar* (gypsy moth); *Malacosoma neustria* (tent caterpillar); *Mamestra brassicae* (cabbage armyworm); *Mamestra configurata* (Bertha armyworm); *Operophtera brumata* (winter moth); *Ostrinia nubilalis* (European corn borer), *Panolis flammea* (pine beauty moth), *Phyllocnistis citrella* (citrus leafminer); *Pieris brassicae* (cabbage white butterfly); *Rachiplusia ni* (soybean looper); *Spodoptera exigua* (beet armywonn); *Spodoptera littoralis* (cotton leafworm); *Sylepta derogata* (cotton leaf roller); *Trichoplusia ni* (cabbage looper); Orthoptera such as the common cricket *Acheta domesticus*, tree locusts (*Anacridium* spp.), the migratory locust *Locusta migratoria*, the twostriped grasshopper *Melanoplus bivittatus*, the differential grasshopper *Melanoplus differentialis*, the red-legged grasshopper *Melanoplus femurrubrum*, the migratory grasshopper *Melanoplus sanguinipes*, the northern mole cricket *Neocurtilla hexadectyla*, the red locust *Nomadacris septemfasciata*, the shortwinged mole cricket *Scapteriscus abbreviatus*, the southern mole cricket *Scapteriscus borellii*, the tawny mole cricket *Scapteriscus vicinus*, and the desert locust *Schistocerca gregaria*; Symphyla such as the garden symphylan *Scutigerella immaculata*; Thysanoptera such as the tobacco thrips *Frankliniella furca*, the flower thrips *Frankliniella intonsa*, the western flower thrips *Frankliniella occidentalism* the cotton bud thrips *Frankliniella schultzei*, the banded greenhouse thrips *Hercinothrips femoralis*, the soybean thrips *Neohydatothrips variabilis*, Kelly's citrus thrips *Pezothrips kellyanus*, the avocado thrips *Scirtothrips perseae*, the melon thrips *Thrips palmi*, and the onion thrips *Thrips tabaci*; and the like, and combinations comprising one or more of the foregoing organisms.

In some embodiments, expression of one or more protein toxins (e.g., insecticidal proteins) in the CESA-inhibiting herbicides-tolerant plants is effective for controlling flea beetles, i.e. members of the flea beetle tribe of family Chrysomelidae, preferably against *Phyllotreta* spp., such as *Phyllotreta cruciferae* and/or *Phyllotreta triolata*. In other embodiments, expression of one or more protein toxins {e.g., insecticidal proteins) in the CESA-inhibiting herbicides-tolerant plants is effective for controlling cabbage seedpod weevil, the Bertha armyworm, *Lygus* bugs, or the diamondback moth.

Furthermore, in one embodiment, CESA-inhibiting herbicides-tolerant plants are also covered which are, e.g. by the use of recombinant DNA techniques and/or by breeding and/or otherwise selected for such traits, rendered able to synthesize one or more proteins to increase the resistance or tolerance of those plants to bacterial, viral or fungal pathogens. The methods for producing such genetically modified plants are generally known to the person skilled in the art.

Furthermore, in another embodiment, CESA-inhibiting herbicides-tolerant plants are also covered which are, e.g. by the use of recombinant DNA techniques and/or by breeding and/or otherwise selected for such traits, rendered able to synthesize one or more proteins to increase the productivity (e.g. oil content), tolerance to drought, salinity or other growth-limiting environmental factors or tolerance to pests and fungal, bacterial or viral pathogens of those plants.

Furthermore, in other embodiments, CESA-inhibiting herbicides-tolerant plants are also covered which are, e.g. by the use of recombinant DNA techniques and/or by breeding and/or otherwise selected for such traits, altered to contain a modified amount of one or more substances or new substances, for example, to improve human or animal nutrition, e.g. oil crops that produce health-promoting long-chain omega-3 fatty acids or unsaturated omega-9 fatty acids (e.g. Nexera® rape, Dow Agro Sciences, Canada).

Furthermore, in some embodiments, CESA-inhibiting herbicides-tolerant plants are also covered which are, e.g. by the use of recombinant DNA techniques and/or by breeding and/or otherwise selected for such traits, altered to contain increased amounts of vitamins and/or minerals, and/or improved profiles of nutraceutical compounds.

In one embodiment, CESA-inhibiting herbicides-tolerant plants of the present invention, relative to a wild-type plant, comprise an increased amount of, or an improved profile of, a compound selected from the group consisting of: glucosinolates (e.g., glucoraphanin (4-methylsulfinylbutyl-glucosinolate), sulforaphane, 3-indolylmethyl-glucosinolate (glucobrassicin), 1-methoxy-3-indolylmethyl-glucosinolate (neoglucobrassicin)); phenolics (e.g., flavonoids (e.g., quercetin, kaempferol), hydroxycinnamoyl derivatives (e.g., 1,2,2'-trisinapoylgentiobiose, 1,2-diferuloylgentiobiose, 1,2'-disinapoyl-2-feruloylgentiobiose, 3-0-caffeoyl-quinic (neochlorogenic acid)); and vitamins and minerals (e.g., vitamin C, vitamin E, carotene, folic acid, niacin, riboflavin, thiamine, calcium, iron, magnesium, potassium, selenium, and zinc).

In another embodiment, CESA-inhibiting herbicides-tolerant plants of the present invention, relative to a wild-type plant, comprise an increased amount of, or an improved profile of, a compound selected from the group consisting of: progoitrin; isothiocyanates; indoles (products of glucosinolate hydrolysis); glutathione; carotenoids such as beta-carotene, lycopene, and the xanthophyll carotenoids such as lutein and zeaxanthin; phenolics comprising the flavonoids such as the flavonols (e.g. quercetin, rutin), the flavans/tannins (such as the procyanidins comprising coumarin, proanthocyanidins, catechins, and anthocyanins); flavones; phytoestrogens such as coumestans, lignans, resveratrol, isoflavones e.g. genistein, daidzein, and glycitein; resorcyclic acid lactones; organosulphur compounds; phytosterols; terpenoids such as carnosol, rosmarinic acid, glycyrrhizin and saponins; chlorophyll; chlorphyllin, sugars, anthocyanins, and vanilla.

In other embodiments, CESA-inhibiting herbicides-tolerant plants of the present invention, relative to a wild-type plant, comprise an increased amount of, or an improved profile of, a compound selected from the group consisting of: vincristine, vinblastine, taxanes (e.g., taxol (paclitaxel), baccatin III, 10-desacetylbaccatin III, 10-desacetyl taxol, xylosyl taxol, 7-epitaxol, 7-epibaccatin III, 10-desacetylcephalomannine, 7-epicephalomannine, taxotere, cephalomannine, xylosyl cephalomannine, taxagifine, 8-benxoyloxy taxagifine, 9-acetyloxy taxusin, 9-hydroxy taxusin, taiwanxam, taxane 1a, taxane 1b, taxane 1c, taxane 1d, GMP paclitaxel, 9-dihydro 13-acetylbaccatin III, 10-desacetyl-7-epitaxol, tetrahydrocannabinol (THC), cannabidiol (CBD), genistein, diadzein, codeine, morphine, quinine, shikonin, ajmalacine, serpentine, and the like.

In other aspects, a method for treating a plant of the present invention is provided.

In some embodiments, the method comprises contacting the plant with an agronomically acceptable composition. In one embodiment, the agronomically acceptable composition comprises a CESA inhibiting herbicide A. I, such as an azine as described herein.

In another aspect, the present invention provides a method for preparing a descendent seed. The method comprises planting a seed of or capable of producing a plant of the present invention. In one embodiment, the method further comprises growing a descendent plant from the seed; and harvesting a descendant seed from the descendent plant. In other embodiments, the method further comprises applying a CESA-inhibiting herbicides herbicidal composition to the descendent plant.

In another embodiment, the invention refers to harvestable parts of the plant according to the present invention. Preferably, the harvestable parts comprise the CESA nucleic acid or CESA protein of the present invention. The harvestable parts may be seeds, roots, leaves and/or flowers comprising the CESA nucleic acid or CESA protein or parts thereof. Preferred parts of soy plants are soy beans comprising the CESA nucleic acid or CESA protein.

In another embodiment, the invention refers to products derived from a plant according to the present invention, parts thereof or harvestable parts thereof. A preferred plant product is fodder, seed meal, oil, or seed-treatment-coated seeds. Preferably, the meal and/or oil comprise the CESA nucleic acids or CESA proteins.

In another embodiment, the invention refers to a method for the production of a product, which method comprises
a) growing the plants of the invention or obtainable by the methods of invention and
b) producing said product from or by the plants of the invention and/or parts, e.g. seeds, of these plants.

In a further embodiment the method comprises the steps
a) growing the plants of the invention,
b) removing the harvestable parts as defined above from the plants and
c) producing said product from or by the harvestable parts of the invention.

The product may be produced at the site where the plant has been grown, the plants and/or parts thereof may be removed from the site where the plants have been grown to produce the product. Typically, the plant is grown, the desired harvestable parts are removed from the plant, if feasible in repeated cycles, and the product made from the harvestable parts of the plant. The step of growing the plant may be performed only once each time the methods of the invention is performed, while allowing repeated times the steps of product production e.g. by repeated removal of harvestable parts of the plants of the invention and if necessary further processing of these parts to arrive at the product. It is also possible that the step of growing the plants of the invention is repeated and plants or harvestable parts are stored until the production of the product is then performed once for the accumulated plants or plant parts. Also, the steps of growing the plants and producing the product may be performed with an overlap in time, even simultaneously to a large extend or sequentially. Generally the plants are grown for some time before the product is produced.

In one embodiment the products produced by said methods of the invention are plant products such as, but not limited to, a foodstuff, feedstuff, a food supplement, feed supplement, fiber, cosmetic and/or pharmaceutical. Foodstuffs are regarded as compositions used for nutrition and/or for supplementing nutrition. Animal feedstuffs and animal feed supplements, in particular, are regarded as foodstuffs.

In another embodiment the inventive methods for the production are used to make agricultural products such as, but not limited to, plant extracts, proteins, amino acids, carbohydrates, fats, oils, polymers, vitamins, and the like.

It is possible that a plant product consists of one or more agricultural products to a large extent.

Herbicides

As described above, the present invention provides nucleic acids, polypeptides, conferring tolerance of plants to compounds/herbicides interfering or inhibiting cell wall (cellulose) biosynthesis by interfering with the activity of cellulose synthase ("CESA-inhibiting herbicides"), also known to the person skilled in the art as Cellulose Biosynthesis Inhibitors (CBI).

Examples of herbicides which can be used according to the present invention, i.e. to which the plants according to the present invention are tolerant/resistant to, are compounds known to the skilled artisan as azines. Examples of Azines are described in detail in the following patent applications depicted in the following Table 1, which are incorporated by reference in its entirety.

TABLE 1

| No.: | Structural Formula | Publication or Application number/ Internal reference |
|---|---|---|
| 1 | 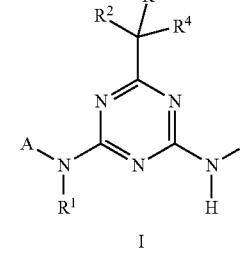 (I) | WO 2014/064094 PF74283 |
| 2 | 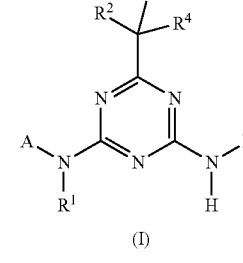 (I) | WO 2015/007711 PF75365 |
| 3 | 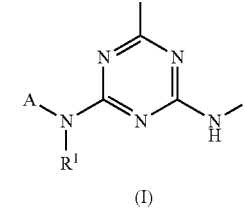 (I) | WO 2015/144881 PF76068 |
| 4 | 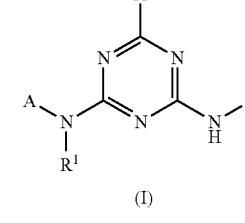 (I) | WO 2015/150541 PF76069 |
| 5 | 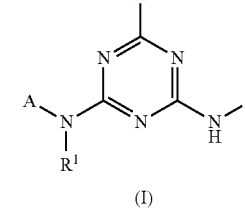 (I) | EP 14163742.1 PF76635 |

TABLE 1-continued

| No.: | Structural Formula | Publication or Application number/ Internal reference |
|---|---|---|
| 6 | 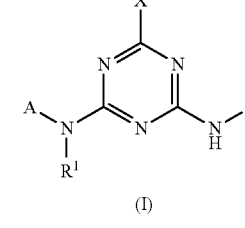 (I) | EP 14163743.9 PF76636 |
| 7 | 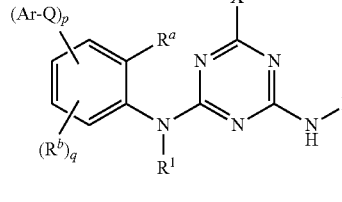 | WO 2015/162166 PF76857 |
| 8 | 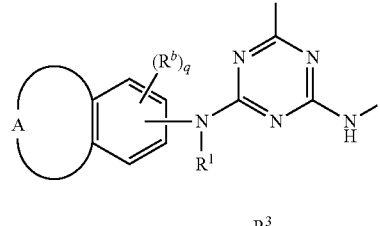 | WO 2015/162169 PF76888 |
| 9 | 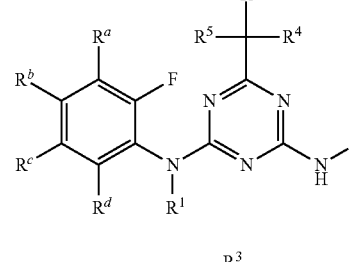 | WO 2015/155271 PF76890 |
| 10 | 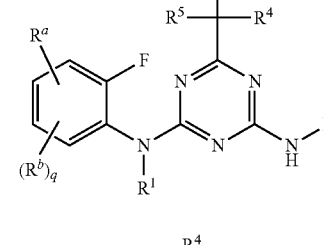 | WO 2015/155272 PF76930 |
| 11 | 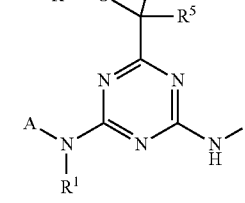 (I) | WO 2015/155273 PF77027 |

TABLE 1-continued

| No.: | Structural Formula | Publication or Application number/ Internal reference |
|---|---|---|
| 12 | | Indaziflam |
| 13 | | Triazofenamid |
| 14 | 1-[4-chloro-3-(2,2,3,3,3-pentafluoropropoxymethyl)phenyl]-5-phenyl-1,2,4-triazole-3-carboxamide | Flupoxam |

Examples of preferred CESA inhibiting herbicides from the group of so-called azines which can be used according to the present invention are compounds having the Formula (I), known to the skilled artisan as azines.

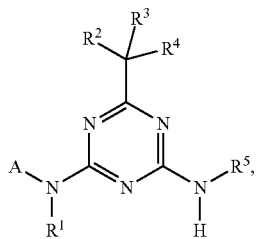

I wherein
A is phenyl, which is substituted by two to five substituents selected from the group consisting of halogen, CN, $NO_2$, $C_1$-$C_6$-alkyl, $C_1$-$C_6$-haloalkyl, $C_2$-$C_6$-alkenyl, $C_2$-$C_6$-haloalkenyl, $C_2$-$C_6$-alkynyl, $C_1$-$C_6$-haloalkynyl, OH, $C_1$-$C_6$-alkoxy, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)carbonyl, ($C_1$-$C_6$-alkoxy)carbonyl;

$R^1$ H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl, ($C_1$-$C_6$-alkoxy)carbonyl, ($C_1$-$C_6$-alkyl)sulfonyl or phenylsulfonyl,
wherein the phenyl is unsubstituted or substituted by one to five substituents selected from the group consisting of halogen, CN, $NO_2$, $C_1$-$C_6$-alkyl, $C_1$-$C_6$-haloalkyl and $C_1$-$C_6$-alkoxy;

$R^2$ H, halogen, CN, $C_1$-$C_6$-alkyl, $C_1$-$C_6$-haloalkyl, $C_2$-$C_6$-alkenyl, $C_3$-$C_6$-alkynyl, $C_3$-$C_6$-cycloalkyl, $C_3$-$C_6$-cycloalkenyl, OH, $C_1$-$C_6$-alkoxy or $C_1$-$C_6$-alkoxy-$C_1$-$C_6$-alkyl;

$R^3$ H, halogen, CN, $C_1$-$C_6$-alkyl, $C_1$-$C_6$-haloalkyl or $C_1$-$C_6$-alkoxy;

$R^4$ H, halogen, CN, $C_1$-$C_6$-alkyl or $C_1$-$C_6$-haloalkyl; or $R^3$ and $R^4$ together with the carbon atom to which they are attached form a moiety selected from the group consisting of carbonyl, $C_2$-$C_6$-alkenyl, $C_3$-$C_6$-cycloalkyl, $C_3$-$C_6$-cycloalkenyl and three- to six-membered heterocyclyl,
wherein the $C_3$-$C_6$-cycloalkyl, $C_3$-$C_6$-cycloalkenyl, or three- to six-membered heterocyclyl is unsubstituted or substituted by one to three substituents selected from halogen, CN, $C_1$-$C_6$-alkyl and $C_1$-$C_6$-alkoxy; and $R^5$ H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl, ($C_1$-$C_6$-alkoxy)carbonyl, ($C_1$-$C_6$-alkyl)sulfonyl or phenylsulfonyl, wherein the phenyl is unsubstituted or substituted by one to five substituents selected from the group consisting of halogen, CN, $NO_2$, $C_1$-$C_6$-alkyl, $C_1$-$C_6$-haloalkyl and $C_1$-$C_6$-alkoxy;

including their agriculturally acceptable salts or N-oxides.

Preferably the present invention provides azines of formula (I), wherein
A is 2-fluoro-phenyl, which is substituted by one to four substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)carbonyl and ($C_1$-$C_6$-alkoxy)-carbonyl;

$R^1$ H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl, ($C_1$-$C_6$-alkoxy)carbonyl, ($C_1$-$C_6$-alkyl)sulfonyl or phenylsulfonyl,
wherein the phenyl is unsubstituted or substituted by one to five substituents selected from the group consisting of halogen, CN, $NO_2$, $C_1$-$C_6$-alkyl, $C_1$-$C_6$-haloalkyl and $C_1$-$C_6$-alkoxy;

$R^2$ H, halogen, CN, $C_1$-$C_6$-alkyl, $C_1$-$C_6$-haloalkyl, $C_2$-$C_6$-alkenyl, $C_3$-$C_6$-alkynyl, $C_3$-$C_6$-cycloalkyl, $C_3$-$C_6$-cycloalkenyl, OH, $C_1$-$C_6$-alkoxy or $C_1$-$C_6$-alkoxy-$C_1$-$C_6$-alkyl;

$R^3$ H, halogen, CN, $C_1$-$C_6$-alkyl, $C_1$-$C_6$-haloalkyl or $C_1$-$C_6$-alkoxy;

$R^4$ H, halogen, CN, $C_1$-$C_6$-alkyl or $C_1$-$C_6$-haloalkyl; or $R^3$ and $R^4$ together with the carbon atom to which they are attached form a moiety selected from the group consisting of carbonyl, $C_2$-$C_6$-alkenyl, $C_3$-$C_6$-cycloalkyl, $C_3$-$C_6$-cycloalkenyl and three- to six-membered heterocyclyl,
wherein the $C_3$-$C_6$-cycloalkyl, $C_3$-$C_6$-cycloalkenyl or and three- to six-membered heterocyclyl is unsubstituted or substituted by one to three substituents selected from halogen, CN, $C_1$-$C_6$-alkyl and $C_1$-$C_6$-alkoxy; and $R^5$ H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl, ($C_1$-$C_6$-alkoxy)carbonyl, ($C_1$-$C_6$-alkyl)sulfonyl or phenylsulfonyl,
wherein the phenyl is unsubstituted or substituted by one to five substituents selected from the group consisting of halogen, CN, $NO_2$, $C_1$-$C_6$-alkyl, $C_1$-$C_6$-haloalkyl and $C_1$-$C_6$-alkoxy;

including their agriculturally acceptable salts or N-oxides.

Useful for the present invention are also agrochemical compositions comprising at least one azines of formula (I) and auxiliaries customary for formulating crop protection agents.

The present invention also provides the use of azines of formula (I) as herbicides, i.e. for controlling harmful plants.

If the azines of formula (I) as described herein are capable of forming geometrical isomers, for example E/Z isomers, it is possible to use both, the pure isomers and mixtures thereof, in the compositions according to the invention.

If the azines of formula (I) as described herein have one or more centres of chirality and, as a consequence, are present as enantiomers or diastereomers, it is possible to use both, the pure enantiomers and diastereomers and their mixtures, in the compositions according to the invention.

If the azines of formula (I) as described herein have ionizable functional groups, they can also be employed in the form of their agriculturally acceptable salts. Suitable are, in general, the salts of those cations and the acid addition salts of those acids whose cations and anions, respectively, have no adverse effect on the activity of the active compounds.

Preferred cations are the ions of the alkali metals, preferably of lithium, sodium and potassium, of the alkaline earth metals, preferably of calcium and magnesium, and of the transition metals, preferably of manganese, copper, zinc and iron, further ammonium and substituted ammonium in which one to four hydrogen atoms are replaced by $C_1$-$C_4$-alkyl, hydroxy-$C_1$-$C_4$-alkyl, $C_1$-$C_4$-alkoxy-$C_1$-$C_4$-alkyl, hydroxy-$C_1$-$C_4$-alkoxy-$C_1$-$C_4$-alkyl, phenyl or benzyl, preferably ammonium, methylammonium, isopropylammonium, dimethylammonium, diisopropylammonium, trimethylammonium, heptylammonium, dodecylammonium, tetradecylammonium, tetramethylammonium, tetraethylammonium, tetrabutylammonium, 2-hydroxyethylammonium (olamine salt), 2-(2-hydroxyeth-1-oxy)eth-1-ylammonium (diglycolamine salt), di(2-hydroxyeth-1-yl)ammonium (diolamine salt), tris(2-hydroxyethyl)ammonium (trolamine salt), tris(2-hydroxypropyl)ammonium, benzyltrimethylammonium, benzyltriethylammonium, N,N,N-trimethylethanolammonium (choline salt), furthermore phosphonium ions, sulfonium ions, preferably tri($C_1$-$C_4$-alkyl)sulfonium, such as trimethylsulfonium, and sulfoxonium ions, preferably tri($C_1$-$C_4$-alkyl)sulfoxonium, and finally the salts of polybasic amines such as N,N-bis-(3-aminopropyl)methylamine and diethylenetriamine.

Anions of useful acid addition salts are primarily chloride, bromide, fluoride, iodide, hydrogensulfate, methylsulfate, sulfate, dihydrogenphosphate, hydrogenphosphate, nitrate, bicarbonate, carbonate, hexafluorosilicate, hexafluorophosphate, benzoate and also the anions of $C_1$-$C_4$-alkanoic acids, preferably formate, acetate, propionate and butyrate.

The organic moieties mentioned in the definition of the variables, e.g. $R^1$ to $R^5$, are—like the term halogen—collective terms for individual enumerations of the individual group members. The term halogen denotes in each case fluorine, chlorine, bromine or iodine. All hydrocarbon chains, i.e. all alkyl, haloalkyl, alkenyl, alkynyl, alkoxy, alkylthio, alkylsulfinyl, alkylsulfonyl, (alkyl)amino, di(alkyl)amino chains can be straight-chain or branched, the prefix $C_n$-$C_m$ denoting in each case the possible number of carbon atoms in the group.

Examples of such meanings are:

$C_1$-$C_4$-alkyl: for example $CH_3$, $C_2H_5$, n-propyl, $CH(CH_3)_2$, n-butyl, $CH(CH_3)$—$C_2H_5$, $CH_2$=CH$(CH_3)_2$ and $C(CH_3)_3$;

$C_1$-$C_6$-alkyl and also the $C_1$-$C_6$-alkyl moieties of ($C_1$-$C_6$-alkyl)carbonyl, $C_1$-$C_6$-alkyoxy-$C_1$-$C_6$-alkyl: $C_1$-$C_4$-alkyl as mentioned above, and also, for example, n-pentyl, 1-methylbutyl, 2-methylbutyl, 3-methylbutyl, 2,2-dimethylpropyl, 1-ethylpropyl, n-hexyl, 1,1-dimethylpropyl, 1,2-dimethylpropyl, 1-methylpentyl, 2-methylpentyl, 3-methylpentyl, 4-methylpentyl, 1,1-dimethylbutyl, 1,2-dimethylbutyl, 1,3-dimethylbutyl, 2,2-dimethylbutyl, 2,3-dimethylbutyl, 3,3-dimethylbutyl, 1-ethylbutyl, 2-ethylbutyl, 1,1,2-trimethylpropyl, 1,2,2-trimethylpropyl, 1-ethyl-1-methylpropyl or 1-ethyl-2-methylpropyl, preferably methyl, ethyl, n-propyl, 1-methylethyl, n-butyl, 1,1-dimethylethyl, n-pentyl or n-hexyl;

$C_1$-$C_4$-haloalkyl: a $C_1$-$C_4$-alkyl radical as mentioned above which is partially or fully substituted by fluorine, chlorine, bromine and/or iodine, for example, chloromethyl, dichloromethyl, trichloromethyl, fluoromethyl, difluoromethyl, trifluoromethyl, chlorofluoromethyl, dichlorofluoromethyl, chlorodifluoromethyl, bromomethyl, iodomethyl, 2-fluoroethyl, 2-chloroethyl, 2-bromoethyl, 2-iodoethyl, 2,2-difluoroethyl, 2,2,2-trifluoroethyl, 2-chloro-2-fluoroethyl, 2-chloro-2,2-difluoroethyl, 2,2-dichloro-2-fluoroethyl, 2,2,2-trichloroethyl, pentafluoroethyl, 2-fluoropropyl, 3-fluoropropyl, 2,2-difluoropropyl, 2,3-difluoropropyl, 2-chloropropyl, 3-chloropropyl, 2,3-dichloropropyl, 2-bromopropyl, 3-bromopropyl, 3,3,3-trifluoropropyl, 3,3,3-trichloropropyl, 2,2,3,3,3-pentafluoropropyl, heptafluoropropyl, 1-(fluoromethyl)-2-fluoroethyl, 1-(chloromethyl)-2-chloroethyl, 1-(bromomethyl)-2-bromoethyl, 4-fluorobutyl, 4-chlorobutyl, 4-bromobutyl, nonafluorobutyl, 1,1,2,2,-tetrafluoroethyl and 1-trifluoromethyl-1,2,2,2-tetrafluoroethyl;

$C_1$-$C_6$-haloalkyl: $C_1$-$C_4$-haloalkyl as mentioned above, and also, for example, 5-fluoropentyl, 5-chloropentyl, 5-bromopentyl, 5-iodopentyl, undecafluoropentyl, 6-fluorohexyl, 6-chlorohexyl, 6-bromohexyl, 6-iodohexyl and dodecafluorohexyl;

$C_3$-$C_6$-cycloalkyl: monocyclic saturated hydrocarbons having 3 to 6 ring members, such as cyclopropyl, cyclobutyl, cyclopentyl and cyclohexyl;

$C_2$-$C_6$-alkenyl: for example ethenyl, 1-propenyl, 2-propenyl, 1-methylethenyl, 1-butenyl, 2-butenyl, 3-butenyl, 1-methyl-1-propenyl, 2-methyl-1-propenyl, 1-methyl-2-propenyl, 2-methyl-2-propenyl. 1-pentenyl. 2-pentenyl. 3-pentenyl. 4-pentenyl. 1-methyl-1-butenyl. 2-methyl-1-butenyl, 3-methyl-1-butenyl, 1-methyl-2-butenyl, 2-methyl-2-butenyl, 3-methyl-2-butenyl, 1-methyl-3-butenyl, 2-methyl-3-butenyl, 3-methyl-3-butenyl, 1,1-dimethyl-2-propenyl, 1,2-dimethyl-1-propenyl, 1,2-dimethyl-2-propenyl, 1-ethyl-1-propenyl, 1-ethyl-2-propenyl, 1-hexenyl, 2-hexenyl, 3-hexenyl, 4-hexenyl, 5-hexenyl, 1-methyl-1-pentenyl, 2-methyl-1-pentenyl, 3-methyl-1-pentenyl, 4-methyl-1-pentenyl, 1-methyl-2-pentenyl, 2-methyl-2-pentenyl, 3-methyl-2-pentenyl, 4-methyl-2-pentenyl, 1-methyl-3-pentenyl, 2-methyl-3-pentenyl, 3-methyl-3-pentenyl, 4-methyl-3-pentenyl, 1-methyl-4-pentenyl, 2-methyl-4-pentenyl, 3-methyl-4-pentenyl, 4-methyl-4-pentenyl, 1,1-dimethyl-2-butenyl, 1,1-dimethyl-3-butenyl, 1,2-dimethyl-1-butenyl, 1,2-dimethyl-2-butenyl, 1,2-dimethyl-3-butenyl, 1,3-dimethyl-1-butenyl, 1,3-dimethyl-2-butenyl, 1,3-dimethyl-3-butenyl, 2,2-dimethyl-3-butenyl, 2,3-dimethyl-1-butenyl, 2,3-dimethyl-2-butenyl, 2,3-dimethyl-3-butenyl, 3,3-dimethyl-1-butenyl, 3,3-dimethyl-2-butenyl, 1-ethyl-1-butenyl, 1-ethyl-2-butenyl, 1-ethyl-3-butenyl, 2-ethyl-1-butenyl, 2-ethyl-2-butenyl, 2-ethyl-3-butenyl, 1,1,2-trimethyl-2-propenyl, 1-ethyl-1-methyl-2-propenyl, 1-ethyl-2-methyl-1-propenyl and 1-ethyl-2-methyl-2-propenyl;

$C_3$-$C_6$-cycloalkenyl: 1-cyclopropenyl, 2-cyclopropenyl, 1-cyclobutenyl, 2-cyclobutenyl, 1-cyclopentenyl, 2-cyclopentenyl, 1,3-cyclopentadienyl, 1,4-cyclopentadienyl, 2,4-cyclopentadienyl, 1-cyclohexenyl, 2-cyclohexenyl, 3-cyclohexenyl, 1,3-cyclohexadienyl, 1,4-cyclohexadienyl, 2,5-cyclohexadienyl;

$C_3$-$C_6$-alkynyl: for example 1-propynyl, 2-propynyl, 1-butynyl, 2-butynyl, 3-butynyl, 1-methyl-2-propynyl, 1-pentynyl, 2-pentynyl, 3-pentynyl, 4-pentynyl, 1-methyl-2-butynyl, 1-methyl-3-butynyl, 2-methyl-3-butynyl, 3-methyl-1-butynyl, 1,1-dimethyl-2-propynyl, 1-ethyl-2-propynyl, 1-hexynyl, 2-hexynyl, 3-hexynyl, 4-hexynyl, 5-hexynyl, 1-methyl-2-pentynyl, 1-methyl-3-pentynyl, 1-methyl-4-pentynyl, 2-methyl-3-pentynyl, 2-methyl-4-pentynyl, 3-methyl-1-pentynyl, 3-methyl-4-pentynyl, 4-methyl-1-pentynyl, 4-methyl-2-pentynyl, 1,1-dimethyl-2-butynyl, 1,1-dimethyl-3-butynyl, 1,2-dimethyl-3-butynyl, 2,2-dimethyl-3-butynyl, 3,3-dimethyl-1-butynyl, 1-ethyl-2-butynyl, 1-ethyl-3-butynyl, 2-ethyl-3-butynyl and 1-ethyl-1-methyl-2-propynyl;

$C_1$-$C_4$-alkoxy: for example methoxy, ethoxy, propoxy, 1-methylethoxy butoxy, 1-methylpropoxy, 2-methylpropoxy and 1,1-dimethylethoxy;

$C_1$-$C_6$-alkoxy and also the $C_1$-$C_6$-alkoxy moieties of ($C_1$-$C_6$-alkoxy)carbonyl, $C_1$-$C_6$-alkoxy-$C_1$-$C_6$-alkyl: $C_1$-$C_4$-alkoxy as mentioned above, and also, for example, pentoxy, 1-methylbutoxy, 2-methylbutoxy, 3-methoxybutoxy, 1,1-dimethylpropoxy, 1,2-dimethylpropoxy, 2,2-dimethylpropoxy, 1-ethylpropoxy, hexoxy, 1-methylpentoxy, 2-methylpentoxy, 3-methylpentoxy, 4-methylpentoxy, 1,1-dimethylbutoxy, 1,2-dimethylbutoxy, 1,3-dimethylbutoxy, 2,2-dimethylbutoxy, 2,3-dimethylbutoxy, 3,3-dimethylbutoxy, 1-ethylbutoxy, 2-ethylbutoxy, 1,1,2-trimethylpropoxy, 1,2,2-trimethylpropoxy, 1-ethyl-1-methyl-propoxy and 1-ethyl-2-methylpropoxy.

$C_1$-$C_4$-alkylthio: for example methylthio, ethylthio, propylthio, 1-methylethylthio, butylthio, 1-methylpropylthio, 2-methylpropylthio and 1,1-dimethylethylthio;

$C_1$-$C_6$-alkylthio: $C_1$-$C_4$-alkylthio as mentioned above, and also, for example, pentylthio, 1-methylbutylthio, 2-methylbutylthio, 3-methylbutylthio, 2,2-dimethylpropylthio, 1-ethylpropylthio, hexylthio, 1,1-dimethylpropylthio, 1,2-dimethylpropylthio, 1-methylpentylthio, 2-methylpentylthio, 3-methylpentylthio, 4-methylpentylthio, 1,1-dimethylbutylthio, 1,2-dimethylbutylthio, 1,3-dimethylbutylthio, 2,2-dimethylbutylthio, 2,3-dimethylbutylthio, 3,3-dimethylbutylthio, 1-ethyl butylthio, 2-ethyl butylthio, 1,1,2-trimethylpropylthio, 1,2,2-trimethylpropylthio, 1-ethyl-1-methylpropylthio and 1-ethyl-2-methylpropylthio;

$C_1$-$C_6$-alkylsulfinyl ($C_1$-$C_6$-alkyl-S(=O)—): z. B. methylsulfinyl, ethylsulfinyl, propylsulfinyl, 1-methylethylsulfinyl, butylsulfinyl, 1-methylpropylsulfinyl, 2-methylpropylsulfinyl, 1,1-di-methylethylsulfinyl, pentylsulfinyl, 1-methylbutylsulfinyl, 2-methylbutylsulfinyl, 3-methylbutylsulfinyl, 2,2-dimethylpropylsulfinyl, 1-ethylpropylsulfinyl, 1,1-dimethyl-propylsulfinyl, 1,2-dimethylpropylsulfinyl, hexylsulfinyl, 1-methylpentylsulfinyl, 2-methylpentylsulfinyl, 3-methylpentylsulfinyl, 4-methylpentyl-sulfinyl, 1,1-dimethylbutylsulfinyl, 1,2-dimethylbutylsulfinyl, 1,3-dimethylbutyl-sulfinyl, 2,2-dimethylbutylsulfinyl, 2,3-dimethylbutylsulfinyl, 3,3-dimethylbutyl-sulfinyl, 1-ethylbutylsulfinyl, 2-ethylbutylsulfinyl, 1,1,2-trimethylpropylsulfinyl, 1,2,2-trimethylpropylsulfinyl, 1-ethyl-1-methylpropylsulfinyl and 1-ethyl-2-methylpropylsulfinyl;

$C_1$-$C_6$-alkylsulfonyl ($C_1$-$C_6$-alkyl-S(O)—): for example methylsulfonyl, ethylsulfonyl, propylsulfonyl, 1-methylethylsulfonyl, butylsulfonyl, 1-methylpropylsulfonyl, 2-methyl-propylsulfonyl, 1,1-dimethylethylsulfonyl, pentylsulfonyl, 1-methylbutylsulfonyl, 2-methylbutylsulfonyl, 3-methylbutylsulfonyl, 1,1-dimethylpropylsulfonyl, 1,2-di-methylpropylsulfonyl, 2,2-dimethylpropylsulfonyl, 1-ethylpropylsulfonyl, hexylsulfonyl, 1-methylpentylsulfonyl, 2-methylpentylsulfonyl, 3-methylpentylsulfonyl, 4-methylpentylsulfonyl, 1,1-dimethylbutylsulfonyl, 1,2-dimethylbutylsulfonyl, 1,3-dimethylbutylsulfonyl, 2,2-dimethylbutylsulfonyl, 2,3-dimethylbutylsulfonyl, 3,3-dimethylbutylsulfonyl, 1-ethylbutylsulfonyl, 2-ethylbutylsulfonyl, 1,1,2-trimethyl-propylsulfonyl, 1,2,2-trimethylpropylsulfonyl, 1-ethyl-1-methylpropylsulfonyl and 1-ethyl-2-methylpropylsulfonyl;

($C_1$-$C_4$-alkyl)amino: for example methylamino, ethylamino, propylamino, 1-methylethyl-amino, butylamino, 1-methylpropylamino, 2-methylpropylamino or 1,1-dimethylethylamino;

($C_1$-$C_6$-alkyl)amino: ($C_1$-$C_4$-alkylamino) as mentioned above, and also, for example, pentylamino, 1-methylbutylamino, 2-methylbutylamino, 3-methylbutylamino, 2,2-dimethylpropylamino, 1-ethylpropylamino, hexylamino, 1,1-dimethylpropylamino, 1,2-dimethylpropylamino, 1-methylpentylamino, 2-methylpentylamino, 3-methylpentylamino, 4-methylpentylamino, 1,1-dimethylbutylamino, 1,2-dimethylbutylamino, 1,3-dimethylbutylamino, 2,2-dimethylbutylamino, 2,3-dimethylbutyl-amino 3,3-dimethylbutyl-amino, 1-ethylbutylamino, 2-ethylbutylamino, 1,1,2-trimethylpropylamino, 1,2,2-trimethyl-propylamino, 1-ethyl-1-methylpropylamino or 1-ethyl-2-methylpropylamino;

di($C_1$-$C_4$-alkyl)amino: for example N,N-dimethylamino, N,N-diethylamino, N,N-di(1-methylethyl)amino, N,N-dipropylamino, N,N-dibutylamino, N,N-di(1-methylpropyl)amino, N,N-di(2-methylpropyl)amino, N,N-di(1,1-dimethylethyl)amino, N-ethyl-N-methylamino, N-methyl-N-propylamino, N-methyl-N-(1-methylethyl)amino, N-butyl-N-methylamino, N-methyl-N-(1-methylpropyl)amino, N-methyl-N-(2-methylpropyl)amino, N-(1,1-dimethylethyl)-N-methylamino, N-ethyl-N-propylamino, N-ethyl-N-(1-methylethyl)amino, N-butyl-N-ethylamino, N-ethyl-N-(1-methylpropyl)amino, N-ethyl-N-(2-methylpropyl)amino, N-ethyl-N-(1,1-dimethylethyl)amino, N-(1-methylethyl)-N-propylamino, N-butyl-N-propylamino, N-(1-methylpropyl)-N-propylamino, N-(2-methylpropyl)-N-propylamino, N-(1,1-dimethylethyl)-N-propylamino, N-butyl-N-(1-methylethyl)amino, N-(1-methylethyl)-N-(1-methylpropyl)amino, N-(1-methylethyl)-N-(2-methylpropyl)amino, N-(1,1-dimethylethyl)-N-(1-methylethyl)amino, N-butyl-N-(1-methylpropyl) amino, N-butyl-N-(2-methylpropyl)amino, N-butyl-N-(1,1-dimethylethyl)amino, N-(1-methylpropyl)-N-(2- methylpropyl)amino, N-(1,1-dimethylethyl)-N-(1-methylpropyl)amino or N-(1,1-dimethylethyl)-N-(2-methylpropyl)amino;

di($C_1$-$C_6$-alkyl)amino: di($C_1$-$C_4$-alkyl)amino as mentioned above, and also, for example, N-methyl-N-pentylamino, N-methyl-N-(1-methylbutyl)amino, N-methyl-N-(2-methyl-butyl)amino, N-methyl-N-(3-methylbutyl)amino, N-methyl-N-(2,2-dimethylpropyl)amino, N-methyl-N-(1-ethylpropyl)amino, N-methyl-N-hexylamino, N-methyl-N-(1,1-dimethyl-propyl)amino, N-methyl-N-(1,2-dimethylpropyl)amino, N-methyl-N-(1-methylpentyl)amino, N-methyl-N-(2-methylpentyl)amino, N-methyl-N-(3-methylpentyl)amino, N-methyl-N-(4-methylpentyl)amino, N-methyl-N-(1,1-dimethylbutyl)amino, N-methyl-N-(1,2-dimethylbutyl)amino, N-methyl-N-(1,3-dimethylbutyl)amino, N-methyl-N-(2,2-dimethyl-butyl)amino, N-methyl-N-(2,3-dimethylbutyl)amino, N-methyl-N-(3,3-dimethylbutyl)amino, N-methyl-N-(1-ethylbutyl)amino, N-methyl-N-(2-ethylbutyl)amino, N-methyl-N-(1,1,2-trimethylpropyl)amino, N-methyl-N-(1,2,2-trimethylpropyl)amino, N-methyl-N-(1-ethyl-1-methylpropyl)amino, N-methyl-N-(1-ethyl-2-methylpropyl)amino, N-ethyl-N-pentylamino, N-ethyl-N-(1-methylbutyl)amino, N-ethyl-N-(2-methylbutyl)amino, N-ethyl-N-(3-methylbutyl)amino, N-ethyl-N-(2,2-dimethylpropyl)amino, N-ethyl-N-(1-ethylpropyl)amino, N-ethyl-N-hexylamino, N-ethyl-N-(1,1-dimethylpropyl)amino, N-ethyl-N-(1,2-dimethylpropyl)amino, N-ethyl-N-(1-methylpentyl)amino, N-ethyl-N-(2-methylpentyl)amino, N-ethyl-N-(3-methylpentyl)amino, N-ethyl-N-(4-methylpentyl)amino, N-ethyl-N-(1,1-dimethylbutyl)amino, N-ethyl-N-(1,2-dimethylbutyl)amino, N-ethyl-N-(1,3-dimethylbutyl)amino, N-ethyl-N-(2,2-dimethylbutyl)amino, N-ethyl-N-(2,3-dimethylbutyl)amino, N-ethyl-N-(3,3-dimethylbutyl)amino, N-ethyl-N-(1-ethylbutyl)amino, N-ethyl-N-(2-ethylbutyl)amino, N-ethyl-N-(1,1,2-trimethylpropyl)amino, N-ethyl-N-(1,2,2-trimethylpropyl)amino, N-ethyl-N-(1-ethyl-1-methylpropyl)amino, N-ethyl-N-(1-ethyl-2-methylpropyl)amino, N-propyl-N-pentylamino, N-butyl-N-pentylamino, N,N-dipentylamino, N-propyl-N-hexylamino, N-butyl-N-hexylamino, N-pentyl-N-hexylamino or N,N-dihexylamino;

three- to six-membered heterocyclyl: monocyclic saturated or partially unsaturated hydrocarbon having three to six ring members as mentioned above which, in addition to carbon atoms, contains one or two heteroatoms selected from O, S and N;

for example 2-oxiranyl, 2-oxetanyl, 3-oxetanyl, 2-aziridinyl, 3-thietanyl, 1-azetidinyl, 2-azetidinyl, for example 2-tetrahydrofuranyl, 3-tetrahydrofuranyl, 2-tetrahydrothienyl, 3-tetra-hydrothienyl, 2-pyrrolidinyl, 3-pyrrolidinyl, 3-isoxazolidinyl, 4-isoxazolidinyl, 5-isoxazolidinyl, 3-isothiazolidinyl. 4-isothiazolidinyl. 5-isothiazolidinyl. 3-pyrazolidinyl. 4-pyrazolidinyl. 5-pyrazolidinyl, 2-oxazolidinyl, 4-oxazolidinyl, 5-oxazolidinyl, 2-thiazolidinyl, 4-thiazolidinyl, 5-thiazolidinyl, 2-imidazolidinyl, 4-imidazolidinyl;

for example 2,3-dihydrofur-2-yl, 2,3-dihydrofur-3-yl, 2,4-dihydrofur-2-yl, 2,4-dihydrofur-3-yl, 2,3-dihydrothien-2-yl, 2,3-dihydrothien-3-yl, 2,4-dihydrothien-2-yl, 2,4-dihydrothien-3-yl, 4,5-dihydropyrrol-2-yl, 4,5-dihydropyrrol-3-yl, 2,5-dihydropyrrol-2-yl, 2,5-dihydropyrrol-3-yl, 4,5-dihydroisoxazol-3-yl, 2,5-dihydroisoxazol-3-yl, 2,3-dihydroisoxazol-3-yl, 4,5-dihydroisoxazol-4-yl, 2,5-dihydroisoxazol-4-yl, 2,3-dihydroisoxazol-4-yl, 4,5-dihydroisoxazol-5-yl, 2,5-dihydroisoxazol-5-yl, 2,3-dihydroisoxazol-5-yl, 4,5-dihydroisothiazol-3-yl, 2,5-dihydroisothiazol-3-yl, 2,3-dihydroisothiazol-3-yl, 4,5-dihydroisothiazol-4-yl, 2,5-dihydroisothiazol-4-yl, 2,3-dihydroisothiazol-4-yl, 4,5-dihydroisothiazol-5-yl, 2,5-dihydroisothiazol-5-yl, 2,3-dihydroisothiazol-5-yl, 2,3-dihydropyrazol-2-yl, 2,3-dihydropyrazol-3-yl, 2,3-dihydropyrazol-4-yl, 2,3-dihydropyrazol-5-yl, 3,4-dihydropyrazol-3-yl, 3,4-dihydropyrazol-4-yl, 3,4-dihydropyrazol-5-yl, 4,5-dihydropyrazol-3-yl, 4,5-dihydropyrazol-4-yl, 4,5-dihydropyrazol-5-yl, 2,3-dihydroimidazol-2-yl, 2,3-dihydroimidazol-3-yl, 2,3-dihydroimidazol-4-yl, 2,3-dihydroimidazol-5-yl, 4,5-dihydroimidazol-2-yl, 4,5-di-hydroimidazol-4-yl, 4,5-dihydroimidazol-5-yl, 2,5-dihydroimidazol-2-yl, 2,5-dihydroimidazol-4-yl, 2,5-dihydroimidazol-5-yl, 2,3-dihydrooxazol-3-yl, 2,3-dihydrooxazol-4-yl, 2,3-dihydrooxazol-5-yl, 3,4-dihydrooxazol-3-yl, 3,4-dihydrooxazol-4-yl, 3,4-dihydrooxazol-5-yl, 2,3-dihydrothiazol-3-yl, 2,3-dihydrothiazol-4-yl, 2,3-dihydrothiazol-5-yl, 3,4-dihydrothiazol-3-yl, 3,4-dihydrothiazol-4-yl, 3,4-dihydrothiazol-5-yl, 3,4-dihydrothiazol-2-yl, 3,4-dihydrothiazol-3-yl, 3,4-dihydrothiazol-4-yl;

for example 2-piperidinyl, 3-piperidinyl, 4-piperidinyl, 1,3-dioxan-2-yl, 1,3-dioxan-4-yl, 1,3-dioxan-5-yl, 1,4-dioxan-2-yl, 1,3-dithian-2-yl, 1,3-dithian-4-yl, 1,4-dithian-2-yl, 1,3-dithian-5-yl, 2-tetrahydropyranyl, 3-tetrahydropyranyl, 4-tetrahydropyranyl, 2-tetrahydrothiopyranyl, 3-tetrahydrothiopyranyl, 4-tetrahydro-thiopyranyl, 3-hexahydropyridazinyl, 4-hexahydropyridazinyl, 2-hexahydropyrimidinyl, 4-hexahydropyrimidinyl, 5-hexahydropyrimidinyl, 2-piperazinyl, tetrahydro-1,3-oxazin-2-yl, tetrahydro-1,3-oxazin-6-yl, 2-morpholinyl, 3-morpholinyl;

for example 2H-pyran-2-yl, 2H-pyran-3-yl, 2H-pyran-4-yl, 2H-pyran-5-yl, 2H-pyran-6-yl, 3,6-dihydro-2H-pyran-2-yl, 3,6-dihydro-2H-pyran-3-yl, 3,6-dihydro-2H-pyran-4-yl, 3,6-dihydro-2H-pyran-5-yl, 3,6-dihydro-2H-pyran-6-yl, 3,4-dihydro-2H-pyran-3-yl, 3,4-dihydro-2H-pyran-4-yl, 3,4-dihydro-2H-pyran-6-yl, 2H-thiopyran-2-yl, 2H-thiopyran-3-yl, 2H-thiopyran-4-yl, 2H-thiopyran-5-yl, 2H-thiopyran-6-yl, 5,6-dihydro-4H-1,3-oxazin-2-yl;

The preferred embodiments of the invention mentioned herein below have to be understood as being preferred either independently from each other or in combination with one another.

According to a preferred embodiment of the invention preference is also given to those azines of formula (I), wherein the variables, either independently of one another or in combination with one another, have the following meanings:

Preferred are the azines of formula (I), wherein

A is phenyl, which is substituted by two to five substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)carbonyl, ($C_1$-$C_6$-alkoxy)carbonyl;

particularly preferred phenyl, which is substituted by two to five substituents selected from the group consisting of halogen, CN, $C_1$-$C_6$-alkyl and $C_1$-$C_6$-alkoxy; particularly preferred selected from halogen and CN;

also particularly preferred selected from the group consisting of F, Cl, CN and $CH_3$;

especially preferred selected from the group consisting of F, Cl and CN;

especially preferred phenyl, which is substituted by two to four substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;

particularly preferred selected from the group consisting of halogen, CN, $C_1$-$C_6$-alkyl and $C_1$-$C_6$-alkoxy;

especially preferred selected from halogen and CN;

also especially preferred selected from the group consisting of F, Cl, CN and $CH_3$;

more preferred selected from the group consisting of F, Cl and CN;

more preferred phenyl, which is substituted by two substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy) carbonyl;

particularly preferred selected from the group consisting of halogen, CN, $C_1$-$C_6$-alkyl and $C_1$-$C_6$-alkoxy;

especially preferred selected from halogen and CN;

also especially preferred selected from the group consisting of F, Cl, CN and $CH_3$;

more preferred selected from the group consisting of F, Cl and CN;

also more preferred phenyl, which is substituted by three substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;

particularly preferred selected from the group consisting of halogen, CN, $C_1$-$C_6$-alkyl and $C_1$-$C_6$-alkoxy;

especially preferred selected from halogen and CN;

also especially preferred selected from the group consisting of F, Cl, CN and $CH_3$;

more preferred selected from the group consisting of F, Cl and CN;

also more preferred phenyl, which is substituted by four substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;

particularly preferred selected from the group consisting of halogen, CN, $C_1$-$C_6$-alkyl and $C_1$-$C_6$-alkoxy;

especially preferred selected from halogen and CN;

also especially preferred selected from the group consisting of F, Cl, CN and $CH_3$;

more preferred selected from the group consisting of F, Cl and CN.

Also preferred are the azines of formula (I), wherein A is

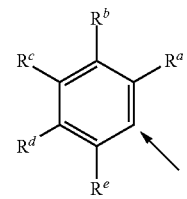

(A.1)

wherein $R^a$ and $R^e$ independently of one another are halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy) carbonyl; and $R^b$, $R^c$ and $R^d$ independently of one another are hydrogen, halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;

particularly preferred $R^a$ and $R^e$ independently of one another are halogen, CN, $C_1$-$C_6$-alkyl or $C_1$-$C_6$-alkoxy; and $R^b$, $R^c$ and $R^d$ independently of one another are hydrogen, halogen, CN, $NO_2$, $C_1$-$C_6$-alkyl, $C_1$-$C_6$-haloalkyl or $C_1$-$C_6$-alkoxy;

especially preferred $R^a$ and $R^e$ independently of one another are halogen or CN; and $R^b$, $R^c$ and $R^d$ independently of one another are hydrogen, halogen, CN, $C_1$-$C_6$-alkyl or $C_1$-$C_6$-alkoxy;

more preferred $R^a$ and $R^e$ are halogen; and $R^b$, $R^c$ and $R^d$ independently of one another are hydrogen, halogen or CN;

most preferred $R^a$ and $R^e$ are halogen; and $R^b$, $R^c$ and $R^d$ are hydrogen;

also most preferred $R^a$, $R^b$, $R^d$ and $R^e$ are halogen; and $R^c$ hydrogen;

also most preferred $R^a$, $R^b$, $R^c$, $R^d$ and $R^e$ are halogen.

Also preferred are the azines of formula (I), wherein A is

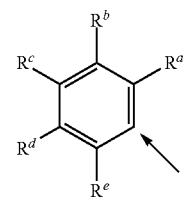

(A.1)

wherein $R^a$ is halogen or CN;

$R^b$ and $R^d$ are H, halogen or CN;

$R^c$ is H or halogen;

$R^e$ is halogen, CN or $C_1$-$C_6$-alkyl;

particularly preferred $R^a$ is halogen;

$R^b$, $R^c$ and $R^d$ are H or halogen; and $R^e$ is halogen or CN;

especially preferred $R^a$, $R^b$, $R^d$ and $R^e$ are halogen; and $R^c$ is H or halogen;

more preferred $R^a$, $R^b$, $R^d$ and $R^e$ are F; and
$R^c$ is H or F.

Especially preferred are the azines of formula (I), wherein A is selected from the group consisting of (A.1.1), (A.1.2) and (A.1.3);
more preferred selected from the group consisting of (A.1.2) and (A.1.3);

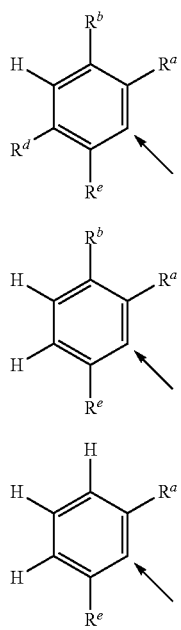

(A.1.1)

(A.1.2)

(A.1.3)

wherein
$R^a$ and $R^e$ independently of one another are halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl; and $R^b$ and $R^d$ independently of one another are halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;

particularly preferred $R^a$ and $R^e$ independently of one another are halogen, CN, $C_1$-$C_6$-alkyl or $C_1$-$C_6$-alkoxy; and $R^b$ and $R^d$ independently of one another are halogen, CN, $NO_2$, $C_1$-$C_6$-alkyl, $C_1$-$C_6$-haloalkyl or $C_1$-$C_6$-alkoxy;

especially preferred $R^a$ and $R^e$ independently of one another halogen or CN; and $R^b$ and $R^d$ independently of one another are halogen, CN, $C_1$-$C_6$-alkyl or $C_1$-$C_6$-alkoxy;

more preferred $R^a$ and $R^e$ are halogen; and $R^b$ and $R^d$ independently of one another are halogen or CN;

most preferred $R^a$, $R^b$, $R^d$ and $R^e$ are halogen.

Also especially preferred are the azines of formula (I), wherein

A is

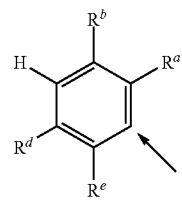

(A.1.1)

wherein $R^a$, $R^b$, $R^d$ and $R^e$ have the meanings, in particular the preferred meanings, as defined above.

Also especially preferred are the azines of formula (I), wherein
A is

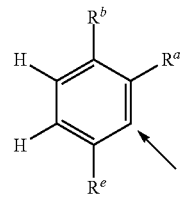

(A.1.2)

wherein $R^a$, $R^b$ and $R^e$ have the meanings, in particular the preferred meanings, as defined above.

Also especially preferred are the azines of formula (I), wherein
A is

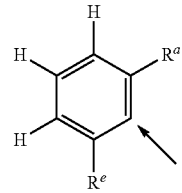

(A.1.3)

wherein $R^a$ and $R^e$ have the meanings, in particular the preferred meanings, as defined above.

Also preferred are the azines of formula (I), wherein
A is 2-fluoro-phenyl, which is substituted by one to four substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)carbonyl and ($C_1$-$C_6$-alkoxy)carbonyl;
particularly preferred 2-fluoro-phenyl, which is substituted by one to four substituents
selected from the group consisting of halogen, CN, $C_1$-$C_6$-alkyl and $C_1$-$C_6$-alkoxy;
particularly preferred selected from halogen and CN;
also particularly preferred selected from the group consisting of F, Cl, CN and $CH_3$;
especially preferred selected from the group consisting of F, Cl and CN;
especially preferred 2-fluoro-phenyl, which is substituted by one to three substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$- alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl and ($C_1$-$C_6$-alkoxy)carbonyl;
  particularly preferred selected from the group consisting of halogen, CN, $C_1$-$C_6$-alkyl and $C_1$-$C_6$-alkoxy;
  especially preferred selected from halogen and CN;
  also especially preferred selected from the group consisting of F, Cl, CN and $CH_3$;
  more preferred selected from the group consisting of F, Cl and CN;
more preferred 2-fluoro-phenyl, which is substituted by one substituent selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl and ($C_1$-$C_6$-alkoxy)carbonyl;
  particularly preferred selected from the group consisting of halogen, CN, $C_1$-$C_6$-alkyl and $C_1$-$C_6$-alkoxy;
  especially preferred selected from halogen and CN;
  also especially preferred selected from the group consisting of F, Cl, CN and $CH_3$;
  more preferred selected from the group consisting of F, Cl and CN;
also more preferred 2-fluoro-phenyl, which is substituted by two substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl and ($C_1$-$C_6$-alkoxy)carbonyl;
  particularly preferred selected from the group consisting of halogen, CN, $C_1$-$C_6$-alkyl and $C_1$-$C_6$-alkoxy;
  especially preferred selected from halogen and CN;
  also especially preferred selected from the group consisting of F, Cl, CN and $CH_3$;
  more preferred selected from the group consisting of F, Cl and CN;
also more preferred 2-fluoro-phenyl, which is substituted by three substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl and ($C_1$-$C_6$-alkoxy)carbonyl;
  particularly preferred selected from the group consisting of halogen, CN, $C_1$-$C_6$-alkyl and $C_1$-$C_6$-alkoxy;
  especially preferred selected from halogen and CN;
  also especially preferred selected from the group consisting of F, Cl, CN and $CH_3$;
  more preferred selected from the group consisting of F, Cl and CN.
Also preferred are the azines of formula (I), wherein A is

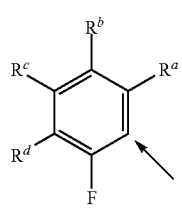

(A.1a)

wherein
  $R^a$ is halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)carbonyl, ($C_1$-$C_6$-alkoxy)carbonyl; and
  $R^b$, $R^c$ and $R^d$ independently of one another are hydrogen, halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;
particularly preferred $R^a$ is halogen, CN, $C_1$-$C_6$-alkyl or $C_1$-$C_6$-alkoxy; and
  $R^b$, $R^c$ and $R^d$ independently of one another are hydrogen, halogen, CN, $NO_2$, $C_1$-$C_6$-alkyl, $C_1$-$C_6$-haloalkyl or $C_1$-$C_6$-alkoxy;
especially preferred $R^a$ is halogen or CN; and
  $R^b$, $R^c$ and $R^d$ independently of one another are hydrogen, halogen, CN, $C_1$-$C_6$-alkyl or $C_1$-$C_6$-alkoxy;
more preferred $R^a$ is halogen; and
  $R^b$, $R^c$ and $R^d$ independently of one another are hydrogen, halogen or CN;
most preferred $R^a$ is halogen; and
  $R^b$, $R^c$ and $R^d$ are hydrogen;
also most preferred $R^a$, $R^b$ and $R^d$ are halogen; and
  $R^c$ is hydrogen;
also most preferred $R^a$, $R^b$, $R^c$ and $R^d$ are halogen.
Also preferred are the azines of formula (I), wherein A is

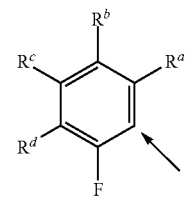

(A.1a)

wherein $R^a$ is halogen, CN or $C_1$-$C_6$-alkyl;
  $R^b$ and $R^d$ are H, halogen or CN; and
  $R^c$ is H or halogen;
particularly preferred $R^a$ is halogen or CN; and
  $R^b$, $R^c$ and $R^d$ are H or halogen;
especially preferred $R^a$, $R^b$ and $R^d$ are halogen; and
  $R^c$ is H or halogen;
Also especially preferred $R^a$, $R^b$ and $R^d$ are halogen; and
  $R^c$ is H, F, Br or I;
more preferred $R^a$, $R^b$ and $R^d$ are F; and
  $R^c$ is F, Br or I;
also more preferred $R^a$, $R^b$ and $R^d$ are F; and
  $R^c$ is H or F.
Especially preferred are the azines of formula (I), wherein A is selected from the group consisting of (A.1a.1), (A.1a.2) and (A.1a.3);
more preferred selected from the group consisting of (A.1.2) and (A.1.3);

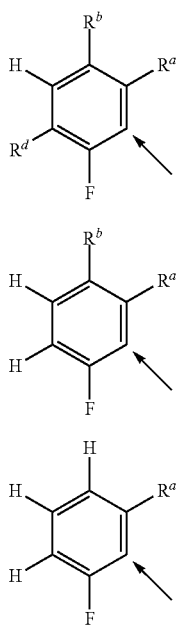

(A.1a.1)

(A.1a.2)

(A.1a.3)

wherein
R$^a$ is halogen, CN, NO$_2$, C$_1$-C$_6$-alkyl, C$_1$-C$_6$-haloalkyl, OH, C$_1$-C$_6$-alkoxy, C$_1$-C$_6$-alkylthio, (C$_1$-C$_6$-alkyl)sulfinyl, (C$_1$-C$_6$-alkyl)sulfonyl, amino, (C$_1$-C$_6$-alkyl)amino, di(C$_1$-C$_6$-alkyl)amino, (C$_1$-C$_6$-alkyl)carbonyl, (C$_1$-C$_6$-alkoxy)carbonyl; and
R$^b$ and R$^d$ independently of one another are halogen, CN, NO$_2$, C$_1$-C$_6$-alkyl, C$_1$-C$_6$-haloalkyl, OH, C$_1$-C$_6$-alkoxy, C$_1$-C$_6$-alkylthio, (C$_1$-C$_6$-alkyl)sulfinyl, (C$_1$-C$_6$-alkyl)sulfonyl, amino, (C$_1$-C$_6$-alkyl)amino, di(C$_1$-C$_6$-alkyl)amino, (C$_1$-C$_6$-alkyl)-carbonyl, (C$_1$-C$_6$-alkoxy)carbonyl;
particularly preferred R$^a$ is halogen, CN, C$_1$-C$_6$-alkyl or C$_1$-C$_6$-alkoxy; and
R$^b$ and R$^d$ independently of one another are halogen, CN, NO$_2$, C$_1$-C$_6$-alkyl, C$_1$-C$_6$-haloalkyl or C$_1$-C$_6$-alkoxy;
especially preferred R$^a$ is halogen or CN; and
R$^b$ and R$^d$ independently of one another are halogen, CN, C$_1$-C$_6$-alkyl or C$_1$-C$_6$-alkoxy;
more preferred R$^a$ is halogen; and
R$^b$ and R$^d$ independently of one another are halogen or CN;
most preferred R$^a$, R$^b$ and R$^d$ are halogen.
Also especially preferred are the azines of formula (I), wherein
A is

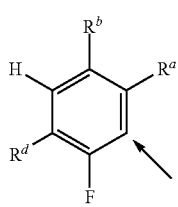

(A.1a.1)

wherein R$^a$, R$^b$ and R$^d$ have the meanings, in particular the preferred meanings, as defined above.

Also especially preferred are the azines of formula (I), wherein
A is

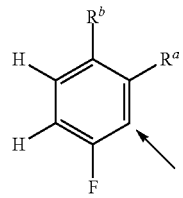

(A.1a.2)

wherein R$^a$ and R$^b$ have the meanings, in particular the preferred meanings, as defined above.

Also especially preferred are the azines of formula (I), wherein
A is

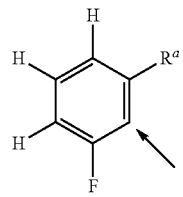

(A.1a.3)

wherein R$^a$ has the meanings, in particular the preferred meanings, as defined above.

Also preferred are the azines of formula (I), wherein
R$^1$ is H, CN, C$_1$-C$_6$-alkyl, C$_1$-C$_6$-haloalkyl, C$_1$-C$_6$-alkoxy-C$_1$-C$_6$-alkyl, C$_1$-C$_6$-alkoxy, (C$_1$-C$_6$-alkyl)carbonyl or (C$_1$-C$_6$-alkyl)sulfonyl;
particularly preferred H, CN, C$_1$-C$_6$-alkyl, C$_1$-C$_6$-alkoxy-C$_1$-C$_6$-alkyl, C$_1$-C$_6$-alkoxy, (C$_1$-C$_6$-alkyl)carbonyl or (C$_1$-C$_6$-alkyl)sulfonyl;
especially preferred H, CN, CH$_3$, CH$_2$OCH$_3$, OCH$_3$, COCH$_3$ or SO$_2$CH$_3$;
more preferred hydrogen.
Also preferred are the azines of formula (I), wherein
R$^2$ is H, halogen, C$_1$-C$_6$-alkyl or C$_1$-C$_6$-haloalkyl;
particularly preferred halogen, C$_1$-C$_6$-alkyl or C$_1$-C$_6$-haloalkyl;
also particularly preferred H, F, Cl, CH$_3$ or CF$_3$.
Also preferred are the azines of formula (I), wherein
R$^3$ and R$^4$ are
independently of one another H, halogen, C$_1$-C$_6$-alkyl or C$_1$-C$_6$-haloalkyl; or together with the carbon atom to which they are attached form a moiety selected from the group consisting of C$_3$-C$_6$-cycloalkyl, C$_3$-C$_6$-cycloalkenyl and three- to six-membered heterocyclyl,
wherein the C$_3$-C$_6$-cycloalkyl, C$_3$-C$_6$-cycloalkenyl or the three- to six-membered heterocyclyl is unsubstituted or substituted by one to three substituents selected from halogen, CN, C$_1$-C$_6$-alkyl and C$_1$-C$_6$-alkoxy;
independently of one another particularly preferred H, halogen, C$_1$-C$_6$-alkyl or C$_1$-C$_6$-haloalkyl; or
together with the carbon atom to which they are attached form a moiety selected from
the group consisting of C$_3$-C$_6$-cycloalkyl and C$_3$-C$_6$-cycloalkenyl, wherein the $C_3$-$C_6$-cycloalkyl or $C_3$-$C_6$-cycloalkenyl is unsubstituted or substituted by one to three substituents selected from halogen, CN, $C_1$-$C_6$-alkyl and $C_1$-$C_6$-alkoxy;
independently of one another especially preferred H, halogen, $C_1$-$C_6$-alkyl or $C_1$-$C_6$-haloalkyl;
independently of one another more preferred H, halogen or $C_1$-$C_6$-alkyl.
Also preferred are the azines of formula (I), wherein
$R^2$ is H, halogen, $C_1$-$C_6$-alkyl; and
$R^3$ and $R^4$ are independently of one another H, halogen, $C_1$-$C_6$-alkyl, or together with the carbon atom to which they are attached form a $C_3$-$C_6$-cycloalkyl;
particularly preferred $R^2$ is H, halogen or $C_1$-$C_6$-alkyl;
$R^3$ is $C_1$-$C_6$-alkyl;
$R^4$ is H, halogen or $C_1$-$C_6$-alkyl;
$R^3$ and $R^4$ together with the carbon atom to which they are attached form a $C_3$-$C_6$-cycloalkyl;
especially preferred $R^2$ is halogen or $C_1$-$C_6$-alkyl;
$R^3$ is $C_1$-$C_6$-alkyl;
$R^4$ is H or $C_1$-$C_6$-alkyl;
more preferred $R^2$ is halogen; and
$R^3$ and $R^4$ are $C_1$-$C_6$-alkyl.
Also preferred are the azines of formula (I), wherein
$R^5$ is H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl or ($C_1$-$C_6$-alkyl)sulfonyl;
particularly preferred H, CN, $C_1$-$C_6$-alkyl, $C_1$-$C_6$-alkoxy-$C_1$-$C_6$-alkyl, $C_1$-$C_6$-alkoxy, ($C_1$-$C_6$-alkyl)carbonyl or ($C_1$-$C_6$-alkyl)sulfonyl;
especially preferred H, CN, $CH_3$, $CH_2OCH_3$, $OCH_3$, $COCH_3$ or $SO_2CH_3$;
more preferred hydrogen.
Also preferred are the azines of formula (I), wherein
A is phenyl, which is substituted by two to five substituents selected from the group consisting of halogen, CN, $C_1$-$C_6$-alkyl and $C_1$-$C_6$-alkoxy; particularly preferred selected from halogen and CN;
also particularly preferred selected from the group consisting of F, Cl, CN and $CH_3$;
especially preferred selected from the group consisting of F, Cl and CN;
particularly preferred phenyl, which is substituted by two to four substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;
particularly preferred selected from the group consisting of halogen, CN, $C_1$-$C_6$-alkyl and $C_1$-$C_6$-alkoxy;
especially preferred selected from halogen and CN;
also especially preferred selected from the group consisting of F, Cl, CN and $CH_3$;
more preferred selected from the group consisting of F, Cl and CN;
especially preferred phenyl, which is substituted by two substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;
particularly preferred selected from the group consisting of halogen, CN, $C_1$-$C_6$-alkyl and $C_1$-$C_6$-alkoxy;
especially preferred selected from halogen and CN;
also especially preferred selected from the group consisting of F, Cl, CN and $CH_3$;
more preferred selected from the group consisting of F, Cl and CN;
also especially preferred phenyl, which is substituted by three substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;
particularly preferred selected from the group consisting of halogen, CN, $C_1$-$C_6$-alkyl and $C_1$-$C_6$-alkoxy;
especially preferred selected from halogen and CN;
also especially preferred selected from the group consisting of F, Cl, CN and $CH_3$; more preferred selected from the group consisting of F, Cl and CN;
also specially preferred phenyl, which is substituted by four substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl;
particularly preferred selected from the group consisting of halogen, CN, $C_1$-$C_6$-alkyl and $C_1$-$C_6$-alkoxy;
especially preferred selected from halogen and CN;
also especially preferred selected from the group consisting of F, Cl, CN and $CH_3$;
more preferred selected from the group consisting of F, Cl and CN;
$R^1$ is H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl or ($C_1$-$C_6$-alkyl)sulfonyl;
particularly preferred H, CN, $C_1$-$C_6$-alkyl, $C_1$-$C_6$-alkoxy-$C_1$-$C_6$-alkyl, $C_1$-$C_6$-alkoxy, ($C_1$-$C_6$-alkyl)carbonyl or ($C_1$-$C_6$-alkyl)sulfonyl;
especially preferred H, CN, $CH_3$, $CH_2OCH_3$, $OCH_3$, $COCH_3$ or $SO_2CH_3$;
more preferred hydrogen.
$R^2$ is H, halogen, $C_1$-$C_6$-alkyl or $C_1$-$C_6$-haloalkyl;
particularly preferred halogen, $C_1$-$C_6$-alkyl or $C_1$-$C_6$-haloalkyl;
also particularly preferred H, F, $CH_3$ or $CF_3$;
$R^3$ and $R^4$ are independently of one another H, halogen, $C_1$-$C_6$-alkyl or $C_1$-$C_6$-haloalkyl; or together with the carbon atom to which they are attached form a moiety selected from the group consisting of $C_3$-$C_6$-cycloalkyl, $C_3$-$C_6$-cycloalkenyl and three- to six-membered heterocyclyl,
wherein the $C_3$-$C_6$-cycloalkyl, $C_3$-$C_6$-cycloalkenyl or the three- to six-membered heterocyclyl is unsubstituted or substituted by one to three substituents selected from halogen, CN, $C_1$-$C_6$-alkyl and $C_1$-$C_6$-alkoxy;
independently of one another particularly preferred H, halogen, $C_1$-$C_6$-alkyl or $C_1$-$C_6$-haloalkyl; or
together with the carbon atom to which they are attached form a moiety selected from the group consisting of $C_3$-$C_6$-cycloalkyl and $C_3$-$C_6$-cycloalkenyl,
wherein the $C_3$-$C_6$-cycloalkyl or $C_3$-$C_6$-cycloalkenyl is unsubstituted or substituted by one to three substituents selected from halogen, CN, $C_1$-$C_6$-alkyl and $C_1$-$C_6$-alkoxy;
independently of one another especially preferred H, halogen, $C_1$-$C_6$-alkyl or $C_1$-$C_6$-haloalkyl;
independently of one another more preferred H, halogen or $C_1$-$C_6$-alkyl; and $R^5$ is H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl or ($C_1$-$C_6$-alkyl)sulfonyl;

particularly preferred H, CN, $C_1$-$C_6$-alkyl, $C_1$-$C_6$-alkoxy-$C_1$-$C_6$-alkyl, $C_1$-$C_6$-alkoxy, ($C_1$-$C_6$-alkyl)carbonyl or ($C_1$-$C_6$-alkyl)sulfonyl;

especially preferred H, CN, $CH_3$, $CH_2OCH_3$, $OCH_3$, $COCH_3$ or $SO_2CH_3$;

more preferred hydrogen.

Particular preference is given to azines of formula (I.a), which correspond to azines of formula (I) wherein A is (A.1) and $R^1$ and $R^5$ are H:

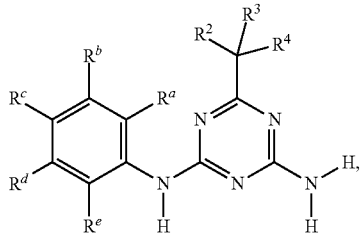

I.a wherein the variables $R^a$, $R^b$, $R^c$, $R^d$, $R^e$, $R^2$, $R^3$ and $R^4$ have the meanings, in particular the preferred meanings, as defined above;

special preference is given to the azines of the formulae (I.a.1) to (I.a.1406) of Table A, where the definitions of the variables $R^a$, $R^b$, $R^c$, $R^d$, $R^e$, $R^2$, $R^3$ and $R^4$ are of particular importance for the compounds according to the invention not only in combination with one another but in each case also on their own:

TABLE A

| No. | $R^a$ | $R^b$ | $R^c$ | $R^d$ | $R^e$ | $R^2$ | $R^3$ | $R^4$ |
|---|---|---|---|---|---|---|---|---|
| I.a.1 | F | H | H | H | F | $CH_3$ | H | H |
| I.a.2 | Cl | H | H | H | F | $CH_3$ | H | H |
| I.a.3 | Br | H | H | H | F | $CH_3$ | H | H |
| I.a.4 | CN | H | H | H | F | $CH_3$ | H | H |
| I.a.5 | $CH_3$ | H | H | H | F | $CH_3$ | H | H |
| I.a.6 | F | H | H | F | F | $CH_3$ | H | H |
| I.a.7 | Cl | H | H | F | F | $CH_3$ | H | H |
| I.a.8 | F | H | H | Cl | F | $CH_3$ | H | H |
| I.a.9 | Cl | H | F | F | F | $CH_3$ | H | H |
| I.a.10 | CN | H | H | F | F | $CH_3$ | H | H |
| I.a.11 | F | H | H | CN | F | $CH_3$ | H | H |
| I.a.12 | CN | H | H | F | F | $CH_3$ | H | H |
| I.a.13 | F | H | F | H | F | $CH_3$ | H | H |
| I.a.14 | Cl | H | F | H | F | $CH_3$ | H | H |
| I.a.15 | CN | H | F | H | F | $CH_3$ | H | H |
| I.a.16 | F | F | F | H | F | $CH_3$ | H | H |
| I.a.17 | Cl | F | F | H | F | $CH_3$ | H | H |
| I.a.18 | F | Cl | F | H | F | $CH_3$ | H | H |
| I.a.19 | Cl | F | F | H | F | $CH_3$ | H | H |
| I.a.20 | CN | F | F | H | F | $CH_3$ | H | H |
| I.a.21 | F | CN | F | H | F | $CH_3$ | H | H |
| I.a.22 | CN | F | F | H | F | $CH_3$ | H | H |
| I.a.23 | F | F | H | F | F | $CH_3$ | H | H |
| I.a.24 | Cl | F | H | F | F | $CH_3$ | H | H |
| I.a.25 | F | Cl | H | F | F | $CH_3$ | H | H |
| I.a.26 | CN | F | H | F | F | $CH_3$ | H | H |
| I.a.27 | F | CN | H | F | F | $CH_3$ | H | H |
| I.a.28 | F | F | F | F | F | $CH_3$ | H | H |
| I.a.29 | Cl | F | F | F | F | $CH_3$ | H | H |
| I.a.30 | F | Cl | F | F | F | $CH_3$ | H | H |
| I.a.31 | CN | F | F | F | F | $CH_3$ | H | H |
| I.a.32 | F | CN | F | F | F | $CH_3$ | H | H |
| I.a.33 | H | F | F | F | F | $CH_3$ | H | H |
| I.a.34 | F | F | Br | F | F | $CH_3$ | H | H |
| I.a.35 | F | F | C≡CH | F | F | $CH_3$ | H | H |
| I.a.36 | $CF_3$ | Cl | H | H | F | $CH_3$ | H | H |
| I.a.37 | F | F | I | F | F | $CH_3$ | H | H |
| I.a.38 | F | H | H | H | F | $CH_3$ | $CH_3$ | H |
| I.a.39 | Cl | H | H | H | F | $CH_3$ | $CH_3$ | H |
| I.a.40 | Br | H | H | H | F | $CH_3$ | $CH_3$ | H |
| I.a.41 | CN | H | H | H | F | $CH_3$ | $CH_3$ | H |
| I.a.42 | $CH_3$ | H | H | H | F | $CH_3$ | $CH_3$ | H |
| I.a.43 | F | H | H | F | F | $CH_3$ | $CH_3$ | H |
| I.a.44 | Cl | H | H | F | F | $CH_3$ | $CH_3$ | H |
| I.a.45 | F | H | H | Cl | F | $CH_3$ | $CH_3$ | H |
| I.a.46 | Cl | H | H | F | F | $CH_3$ | $CH_3$ | H |
| I.a.47 | CN | H | H | F | F | $CH_3$ | $CH_3$ | H |
| I.a.48 | F | H | H | CN | F | $CH_3$ | $CH_3$ | H |
| I.a.49 | CN | H | H | F | F | $CH_3$ | $CH_3$ | H |
| I.a.50 | F | H | F | H | F | $CH_3$ | $CH_3$ | H |
| I.a.51 | Cl | H | F | H | F | $CH_3$ | $CH_3$ | H |
| I.a.52 | CN | H | F | H | F | $CH_3$ | $CH_3$ | H |
| I.a.53 | F | F | F | H | F | $CH_3$ | $CH_3$ | H |
| I.a.54 | Cl | F | F | H | F | $CH_3$ | $CH_3$ | H |
| I.a.55 | F | Cl | F | H | F | $CH_3$ | $CH_3$ | H |
| I.a.56 | Cl | F | F | H | F | $CH_3$ | $CH_3$ | H |
| I.a.57 | CN | F | F | H | F | $CH_3$ | $CH_3$ | H |
| I.a.58 | F | CN | F | H | F | $CH_3$ | $CH_3$ | H |
| I.a.59 | CN | F | F | H | F | $CH_3$ | $CH_3$ | H |
| I.a.60 | F | F | H | F | F | $CH_3$ | $CH_3$ | H |
| I.a.61 | Cl | F | H | F | F | $CH_3$ | $CH_3$ | H |
| I.a.62 | F | Cl | H | F | F | $CH_3$ | $CH_3$ | H |
| I.a.63 | CN | F | H | F | F | $CH_3$ | $CH_3$ | H |
| I.a.64 | F | CN | H | F | F | $CH_3$ | $CH_3$ | H |
| I.a.65 | F | F | F | F | F | $CH_3$ | $CH_3$ | H |
| I.a.66 | Cl | F | F | F | F | $CH_3$ | $CH_3$ | H |
| I.a.67 | F | Cl | F | F | F | $CH_3$ | $CH_3$ | H |
| I.a.68 | CN | F | F | F | F | $CH_3$ | $CH_3$ | H |
| I.a.69 | F | CN | F | F | F | $CH_3$ | $CH_3$ | H |
| I.a.70 | H | F | F | F | F | $CH_3$ | $CH_3$ | H |
| I.a.71 | F | F | Br | F | F | $CH_3$ | $CH_3$ | H |
| I.a.72 | F | F | C≡CH | F | F | $CH_3$ | $CH_3$ | H |
| I.a.73 | $CF_3$ | Cl | H | H | F | $CH_3$ | $CH_3$ | H |
| I.a.74 | F | F | I | F | F | $CH_3$ | $CH_3$ | H |
| I.a.75 | F | H | H | H | F | $CH_3$ | $CH_3$ | $CH_3$ |
| I.a.76 | Cl | H | H | H | F | $CH_3$ | $CH_3$ | $CH_3$ |
| I.a.77 | Br | H | H | H | F | $CH_3$ | $CH_3$ | $CH_3$ |
| I.a.78 | CN | H | H | H | F | $CH_3$ | $CH_3$ | $CH_3$ |
| I.a.79 | $CH_3$ | H | H | H | F | $CH_3$ | $CH_3$ | $CH_3$ |
| I.a.80 | F | H | H | F | F | $CH_3$ | $CH_3$ | $CH_3$ |
| I.a.81 | Cl | H | H | F | F | $CH_3$ | $CH_3$ | $CH_3$ |
| I.a.82 | F | H | H | Cl | F | $CH_3$ | $CH_3$ | $CH_3$ |
| I.a.83 | Cl | H | H | F | F | $CH_3$ | $CH_3$ | $CH_3$ |
| I.a.84 | CN | H | H | F | F | $CH_3$ | $CH_3$ | $CH_3$ |
| I.a.85 | F | H | H | CN | F | $CH_3$ | $CH_3$ | $CH_3$ |
| I.a.86 | CN | H | H | F | F | $CH_3$ | $CH_3$ | $CH_3$ |
| I.a.87 | F | H | F | H | F | $CH_3$ | $CH_3$ | $CH_3$ |
| I.a.88 | Cl | H | F | H | F | $CH_3$ | $CH_3$ | $CH_3$ |
| I.a.89 | CN | H | F | H | F | $CH_3$ | $CH_3$ | $CH_3$ |
| I.a.90 | F | F | F | H | F | $CH_3$ | $CH_3$ | $CH_3$ |
| I.a.91 | Cl | F | F | H | F | $CH_3$ | $CH_3$ | $CH_3$ |
| I.a.92 | F | Cl | F | H | F | $CH_3$ | $CH_3$ | $CH_3$ |
| I.a.93 | Cl | F | F | H | F | $CH_3$ | $CH_3$ | $CH_3$ |
| I.a.94 | CN | F | F | H | F | $CH_3$ | $CH_3$ | $CH_3$ |
| I.a.95 | F | CN | F | H | F | $CH_3$ | $CH_3$ | $CH_3$ |
| I.a.96 | CN | F | F | H | F | $CH_3$ | $CH_3$ | $CH_3$ |
| I.a.97 | F | F | H | F | F | $CH_3$ | $CH_3$ | $CH_3$ |
| I.a.98 | Cl | F | H | F | F | $CH_3$ | $CH_3$ | $CH_3$ |
| I.a.99 | F | Cl | H | F | F | $CH_3$ | $CH_3$ | $CH_3$ |
| I.a.100 | CN | F | H | F | F | $CH_3$ | $CH_3$ | $CH_3$ |
| I.a.101 | F | CN | H | F | F | $CH_3$ | $CH_3$ | $CH_3$ |
| I.a.102 | F | F | F | F | F | $CH_3$ | $CH_3$ | $CH_3$ |
| I.a.103 | Cl | F | F | F | F | $CH_3$ | $CH_3$ | $CH_3$ |
| I.a.104 | F | Cl | F | F | F | $CH_3$ | $CH_3$ | $CH_3$ |
| I.a.105 | CN | F | F | F | F | $CH_3$ | $CH_3$ | $CH_3$ |
| I.a.106 | F | CN | F | F | F | $CH_3$ | $CH_3$ | $CH_3$ |
| I.a.107 | H | F | F | F | F | $CH_3$ | $CH_3$ | $CH_3$ |
| I.a.108 | F | F | Br | F | F | $CH_3$ | $CH_3$ | $CH_3$ |
| I.a.109 | F | F | C≡CH | F | F | $CH_3$ | $CH_3$ | $CH_3$ |
| I.a.110 | $CF_3$ | Cl | H | H | F | $CH_3$ | $CH_3$ | $CH_3$ |
| I.a.111 | F | F | I | F | F | $CH_3$ | $CH_3$ | $CH_3$ |
| I.a.112 | F | H | H | H | F | F | F | F |

TABLE A-continued

| No. | $R^a$ | $R^b$ | $R^c$ | $R^d$ | $R^e$ | $R^2$ | $R^3$ | $R^4$ |
|---|---|---|---|---|---|---|---|---|
| I.a.113 | Cl | H | H | H | F | F | F | F |
| I.a.114 | Br | H | H | H | F | F | F | F |
| I.a.115 | CN | H | H | H | F | F | F | F |
| I.a.116 | CH$_3$ | H | H | H | F | F | F | F |
| I.a.117 | F | H | H | F | F | F | F | F |
| I.a.118 | Cl | H | H | F | F | F | F | F |
| I.a.119 | F | H | H | Cl | F | F | F | F |
| I.a.120 | Cl | H | H | F | F | F | F | F |
| I.a.121 | CN | H | H | F | F | F | F | F |
| I.a.122 | F | H | H | CN | F | F | F | F |
| I.a.123 | CN | H | H | F | F | F | F | F |
| I.a.124 | F | H | F | H | F | F | F | F |
| I.a.125 | Cl | H | F | H | F | F | F | F |
| I.a.126 | CN | H | F | H | F | F | F | F |
| I.a.127 | F | F | F | H | F | F | F | F |
| I.a.128 | Cl | F | F | H | F | F | F | F |
| I.a.129 | F | Cl | F | H | F | F | F | F |
| I.a.130 | Cl | F | F | H | F | F | F | F |
| I.a.131 | CN | F | F | H | F | F | F | F |
| I.a.132 | F | CN | F | H | F | F | F | F |
| I.a.133 | CN | F | F | H | F | F | F | F |
| I.a.134 | F | F | H | F | F | F | F | F |
| I.a.135 | Cl | F | H | F | F | F | F | F |
| I.a.136 | F | Cl | H | F | F | F | F | F |
| I.a.137 | CN | F | H | F | F | F | F | F |
| I.a.138 | F | CN | H | F | F | F | F | F |
| I.a.139 | F | F | F | F | F | F | F | F |
| I.a.140 | Cl | F | F | F | F | F | F | F |
| I.a.141 | F | Cl | F | F | F | F | F | F |
| I.a.142 | CN | F | F | F | F | F | F | F |
| I.a.143 | F | CN | F | F | F | F | F | F |
| I.a.144 | H | F | F | F | F | F | F | F |
| I.a.145 | F | F | Br | F | F | F | F | F |
| I.a.146 | F | F | C≡CH | F | F | F | F | F |
| I.a.147 | CF$_3$ | Cl | H | H | F | F | F | F |
| I.a.148 | F | F | I | F | F | F | F | F |
| I.a.149 | F | H | H | H | F | F | CF$_3$ | F |
| I.a.150 | Cl | H | H | H | F | F | CF$_3$ | F |
| I.a.151 | Br | H | H | H | F | F | CF$_3$ | F |
| I.a.152 | CN | H | H | H | F | F | CF$_3$ | F |
| I.a.153 | CH$_3$ | H | H | H | F | F | CF$_3$ | F |
| I.a.154 | F | H | H | F | F | F | CF$_3$ | F |
| I.a.155 | Cl | H | H | F | F | F | CF$_3$ | F |
| I.a.156 | F | H | H | Cl | F | F | CF$_3$ | F |
| I.a.157 | Cl | H | H | F | F | F | CF$_3$ | F |
| I.a.158 | CN | H | H | F | F | F | CF$_3$ | F |
| I.a.159 | F | H | H | CN | F | F | CF$_3$ | F |
| I.a.160 | CN | H | H | F | F | F | CF$_3$ | F |
| I.a.161 | F | H | F | H | F | F | CF$_3$ | F |
| I.a.162 | Cl | H | F | H | F | F | CF$_3$ | F |
| I.a.163 | CN | H | F | H | F | F | CF$_3$ | F |
| I.a.164 | F | F | F | H | F | F | CF$_3$ | F |
| I.a.165 | Cl | F | F | H | F | F | CF$_3$ | F |
| I.a.166 | F | Cl | F | H | F | F | CF$_3$ | F |
| I.a.167 | Cl | F | F | H | F | F | CF$_3$ | F |
| I.a.168 | CN | F | F | H | F | F | CF$_3$ | F |
| I.a.169 | F | CN | F | H | F | F | CF$_3$ | F |
| I.a.170 | CN | F | F | H | F | F | CF$_3$ | F |
| I.a.171 | F | F | H | F | F | F | CF$_3$ | F |
| I.a.172 | Cl | F | H | F | F | F | CF$_3$ | F |
| I.a.173 | F | Cl | H | F | F | F | CF$_3$ | F |
| I.a.174 | CN | F | H | F | F | F | CF$_3$ | F |
| I.a.175 | F | CN | H | F | F | F | CF$_3$ | F |
| I.a.176 | F | F | F | F | F | F | CF$_3$ | F |
| I.a.177 | Cl | F | F | F | F | F | CF$_3$ | F |
| I.a.178 | F | Cl | F | F | F | F | CF$_3$ | F |
| I.a.179 | CN | F | F | F | F | F | CF$_3$ | F |
| I.a.180 | F | CN | F | F | F | F | CF$_3$ | F |
| I.a.181 | H | F | F | F | F | F | CF$_3$ | F |
| I.a.182 | F | F | Br | F | F | F | CF$_3$ | F |
| I.a.183 | F | F | C≡CH | F | F | F | CF$_3$ | F |
| I.a.184 | CF$_3$ | Cl | H | H | F | F | CF$_3$ | F |
| I.a.185 | F | F | I | F | F | F | CF$_3$ | F |
| I.a.186 | F | H | H | H | F | F | CH$_3$ | F |
| I.a.187 | Cl | H | H | H | F | F | CH$_3$ | F |
| I.a.188 | Br | H | H | H | F | F | CH$_3$ | F |
| I.a.189 | CN | H | H | H | F | F | CH$_3$ | F |
| I.a.190 | CH$_3$ | H | H | H | F | F | CH$_3$ | F |
| I.a.191 | F | H | H | F | F | F | CH$_3$ | F |
| I.a.192 | Cl | H | H | F | F | F | CH$_3$ | F |
| I.a.193 | F | H | H | Cl | F | F | CH$_3$ | F |
| I.a.194 | Cl | H | H | F | F | F | CH$_3$ | F |
| I.a.195 | CN | H | H | F | F | F | CH$_3$ | F |
| I.a.196 | F | H | H | CN | F | F | CH$_3$ | F |
| I.a.197 | CN | H | H | F | F | F | CH$_3$ | F |
| I.a.198 | F | H | F | H | F | F | CH$_3$ | F |
| I.a.199 | Cl | H | F | H | F | F | CH$_3$ | F |
| I.a.200 | CN | H | F | H | F | F | CH$_3$ | F |
| I.a.201 | F | F | F | H | F | F | CH$_3$ | F |
| I.a.202 | Cl | F | F | H | F | F | CH$_3$ | F |
| I.a.203 | F | Cl | F | H | F | F | CH$_3$ | F |
| I.a.204 | Cl | F | F | H | F | F | CH$_3$ | F |
| I.a.205 | CN | F | F | H | F | F | CH$_3$ | F |
| I.a.206 | F | CN | F | H | F | F | CH$_3$ | F |
| I.a.207 | CN | F | F | H | F | F | CH$_3$ | F |
| I.a.208 | F | F | H | F | F | F | CH$_3$ | F |
| I.a.209 | Cl | F | H | F | F | F | CH$_3$ | F |
| I.a.210 | F | Cl | H | F | F | F | CH$_3$ | F |
| I.a.211 | CN | F | H | F | F | F | CH$_3$ | F |
| I.a.212 | F | CN | H | F | F | F | CH$_3$ | F |
| I.a.213 | F | F | F | F | F | F | CH$_3$ | F |
| I.a.214 | Cl | F | F | F | F | F | CH$_3$ | F |
| I.a.215 | F | Cl | F | F | F | F | CH$_3$ | F |
| I.a.216 | CN | F | F | F | F | F | CH$_3$ | F |
| I.a.217 | F | CN | F | F | F | F | CH$_3$ | F |
| I.a.218 | H | F | F | F | F | F | CH$_3$ | F |
| I.a.219 | F | F | Br | F | F | F | CH$_3$ | F |
| I.a.220 | F | F | C≡CH | F | F | F | CH$_3$ | F |
| I.a.221 | CF$_3$ | Cl | H | H | F | F | CH$_3$ | F |
| I.a.222 | F | F | I | F | F | F | CH$_3$ | F |
| I.a.223 | F | H | H | H | F | F | CH$_3$ | H |
| I.a.224 | Cl | H | H | H | F | F | CH$_3$ | H |
| I.a.225 | Br | H | H | H | F | F | CH$_3$ | H |
| I.a.226 | CN | H | H | H | F | F | CH$_3$ | H |
| I.a.227 | CH$_3$ | H | H | H | F | F | CH$_3$ | H |
| I.a.228 | F | H | H | F | F | F | CH$_3$ | H |
| I.a.229 | Cl | H | H | F | F | F | CH$_3$ | H |
| I.a.230 | F | H | H | Cl | F | F | CH$_3$ | H |
| I.a.231 | Cl | H | H | F | F | F | CH$_3$ | H |
| I.a.232 | CN | H | H | F | F | F | CH$_3$ | H |
| I.a.233 | F | H | H | CN | F | F | CH$_3$ | H |
| I.a.234 | CN | H | H | F | F | F | CH$_3$ | H |
| I.a.235 | F | H | F | H | F | F | CH$_3$ | H |
| I.a.236 | Cl | H | F | H | F | F | CH$_3$ | H |
| I.a.237 | CN | H | F | H | F | F | CH$_3$ | H |
| I.a.238 | F | F | F | H | F | F | CH$_3$ | H |
| I.a.239 | Cl | F | F | H | F | F | CH$_3$ | H |
| I.a.240 | F | Cl | F | H | F | F | CH$_3$ | H |
| I.a.241 | Cl | F | F | H | F | F | CH$_3$ | H |
| I.a.242 | CN | F | F | H | F | F | CH$_3$ | H |
| I.a.243 | F | CN | F | H | F | F | CH$_3$ | H |
| I.a.244 | CN | F | F | H | F | F | CH$_3$ | H |
| I.a.245 | F | F | H | F | F | F | CH$_3$ | H |
| I.a.246 | Cl | F | H | F | F | F | CH$_3$ | H |
| I.a.247 | F | Cl | H | F | F | F | CH$_3$ | H |
| I.a.248 | CN | F | H | F | F | F | CH$_3$ | H |
| I.a.249 | F | CN | H | F | F | F | CH$_3$ | H |
| I.a.250 | F | F | F | F | F | F | CH$_3$ | H |
| I.a.251 | Cl | F | F | F | F | F | CH$_3$ | H |
| I.a.252 | F | Cl | F | F | F | F | CH$_3$ | H |
| I.a.253 | CN | F | F | F | F | F | CH$_3$ | H |
| I.a.254 | F | CN | F | F | F | F | CH$_3$ | H |
| I.a.255 | H | F | F | F | F | F | CH$_3$ | H |
| I.a.256 | F | F | Br | F | F | F | CH$_3$ | H |
| I.a.257 | F | F | C≡CH | F | F | F | CH$_3$ | H |
| I.a.258 | CF$_3$ | Cl | H | H | F | F | CH$_3$ | H |
| I.a.259 | F | F | I | F | F | F | CH$_3$ | H |
| I.a.260 | F | H | H | H | F | F | CH$_3$ | CH$_3$ |
| I.a.261 | Cl | H | H | H | F | F | CH$_3$ | CH$_3$ |
| I.a.262 | Br | H | H | H | F | F | CH$_3$ | CH$_3$ |
| I.a.263 | CN | H | H | H | F | F | CH$_3$ | CH$_3$ |
| I.a.264 | CH$_3$ | H | H | H | F | F | CH$_3$ | CH$_3$ |
| I.a.265 | F | H | H | F | F | F | CH$_3$ | CH$_3$ |
| I.a.266 | Cl | H | H | F | F | F | CH$_3$ | CH$_3$ |
| I.a.267 | F | H | H | Cl | F | F | CH$_3$ | CH$_3$ |
| I.a.268 | Cl | H | H | F | F | F | CH$_3$ | CH$_3$ |

TABLE A-continued

| No. | Rᵃ | Rᵇ | Rᶜ | Rᵈ | Rᵉ | R² | R³ | R⁴ |
|---|---|---|---|---|---|---|---|---|
| I.a.269 | CN | H | H | F | F | F | CH₃ | CH₃ |
| I.a.270 | F | H | H | CN | F | F | CH₃ | CH₃ |
| I.a.271 | CN | H | H | F | F | F | CH₃ | CH₃ |
| I.a.272 | F | H | F | H | F | F | CH₃ | CH₃ |
| I.a.273 | Cl | H | F | H | F | F | CH₃ | CH₃ |
| I.a.274 | CN | H | F | H | F | F | CH₃ | CH₃ |
| I.a.275 | F | F | F | H | F | F | CH₃ | CH₃ |
| I.a.276 | Cl | F | F | H | F | F | CH₃ | CH₃ |
| I.a.277 | F | Cl | F | H | F | F | CH₃ | CH₃ |
| I.a.278 | Cl | F | F | H | F | F | CH₃ | CH₃ |
| I.a.279 | CN | F | F | H | F | F | CH₃ | CH₃ |
| I.a.280 | F | CN | F | H | F | F | CH₃ | CH₃ |
| I.a.281 | CN | F | F | H | F | F | CH₃ | CH₃ |
| I.a.282 | F | F | H | F | F | F | CH₃ | CH₃ |
| I.a.283 | Cl | F | H | F | F | F | CH₃ | CH₃ |
| I.a.284 | F | Cl | H | F | F | F | CH₃ | CH₃ |
| I.a.285 | CN | F | H | F | F | F | CH₃ | CH₃ |
| I.a.286 | F | CN | H | F | F | F | CH₃ | CH₃ |
| I.a.287 | F | F | F | F | F | F | CH₃ | CH₃ |
| I.a.288 | Cl | F | F | F | F | F | CH₃ | CH₃ |
| I.a.289 | F | Cl | F | F | F | F | CH₃ | CH₃ |
| I.a.290 | CN | F | F | F | F | F | CH₃ | CH₃ |
| I.a.291 | F | CN | F | F | F | F | CH₃ | CH₃ |
| I.a.292 | H | F | F | F | F | F | CH₃ | CH₃ |
| I.a.293 | F | F | Br | F | F | F | CH₃ | CH₃ |
| I.a.294 | F | F | C≡CH | F | F | F | CH₃ | CH₃ |
| I.a.295 | CF₃ | Cl | H | H | F | F | CH₃ | CH₃ |
| I.a.296 | F | F | I | F | F | F | CH₃ | CH₃ |
| I.a.297 | F | H | H | H | F | Cl | CH₃ | CH₃ |
| I.a.298 | Cl | H | H | H | F | Cl | CH₃ | CH₃ |
| I.a.299 | Br | H | H | H | F | Cl | CH₃ | CH₃ |
| I.a.300 | CN | H | H | H | F | Cl | CH₃ | CH₃ |
| I.a.301 | CH₃ | H | H | H | F | Cl | CH₃ | CH₃ |
| I.a.302 | F | H | H | F | F | Cl | CH₃ | CH₃ |
| I.a.303 | Cl | H | H | F | F | Cl | CH₃ | CH₃ |
| I.a.304 | F | H | H | Cl | F | Cl | CH₃ | CH₃ |
| I.a.305 | Cl | H | F | H | F | Cl | CH₃ | CH₃ |
| I.a.306 | CN | H | H | F | F | Cl | CH₃ | CH₃ |
| I.a.307 | F | H | H | CN | F | Cl | CH₃ | CH₃ |
| I.a.308 | CN | H | F | H | F | Cl | CH₃ | CH₃ |
| I.a.309 | F | H | F | H | F | Cl | CH₃ | CH₃ |
| I.a.310 | Cl | H | F | H | F | Cl | CH₃ | CH₃ |
| I.a.311 | CN | H | F | H | F | Cl | CH₃ | CH₃ |
| I.a.312 | F | F | F | H | F | Cl | CH₃ | CH₃ |
| I.a.313 | Cl | F | F | H | F | Cl | CH₃ | CH₃ |
| I.a.314 | F | Cl | F | H | F | Cl | CH₃ | CH₃ |
| I.a.315 | Cl | F | F | H | F | Cl | CH₃ | CH₃ |
| I.a.316 | CN | F | F | H | F | Cl | CH₃ | CH₃ |
| I.a.317 | F | CN | F | H | F | Cl | CH₃ | CH₃ |
| I.a.318 | CN | F | F | H | F | Cl | CH₃ | CH₃ |
| I.a.319 | F | F | H | F | F | Cl | CH₃ | CH₃ |
| I.a.320 | Cl | F | H | F | F | Cl | CH₃ | CH₃ |
| I.a.321 | F | Cl | H | F | F | Cl | CH₃ | CH₃ |
| I.a.322 | CN | F | H | F | F | Cl | CH₃ | CH₃ |
| I.a.323 | F | CN | H | F | F | Cl | CH₃ | CH₃ |
| I.a.324 | F | F | F | F | F | Cl | CH₃ | CH₃ |
| I.a.325 | Cl | F | F | F | F | Cl | CH₃ | CH₃ |
| I.a.326 | F | Cl | F | F | F | Cl | CH₃ | CH₃ |
| I.a.327 | CN | F | F | F | F | Cl | CH₃ | CH₃ |
| I.a.328 | F | CN | F | F | F | Cl | CH₃ | CH₃ |
| I.a.329 | H | F | F | F | F | Cl | CH₃ | CH₃ |
| I.a.330 | F | F | Br | F | F | Cl | CH₃ | CH₃ |
| I.a.331 | F | F | C≡CH | F | F | Cl | CH₃ | CH₃ |
| I.a.332 | CF₃ | Cl | H | H | F | Cl | CH₃ | CH₃ |
| I.a.333 | F | F | I | F | F | Cl | CH₃ | CH₃ |
| I.a.334 | F | H | H | H | F | F | C₂H₅ | CH₃ |
| I.a.335 | Cl | H | H | H | F | F | C₂H₅ | CH₃ |
| I.a.336 | Br | H | H | H | F | F | C₂H₅ | CH₃ |
| I.a.337 | CN | H | H | H | F | F | C₂H₅ | CH₃ |
| I.a.338 | CH₃ | H | H | H | F | F | C₂H₅ | CH₃ |
| I.a.339 | F | H | H | F | F | F | C₂H₅ | CH₃ |
| I.a.340 | Cl | H | H | F | F | F | C₂H₅ | CH₃ |
| I.a.341 | F | H | H | Cl | F | F | C₂H₅ | CH₃ |
| I.a.342 | Cl | H | H | F | F | F | C₂H₅ | CH₃ |
| I.a.343 | CN | H | H | F | F | F | C₂H₅ | CH₃ |
| I.a.344 | F | H | H | CN | F | F | C₂H₅ | CH₃ |
| I.a.345 | CN | H | H | F | F | F | C₂H₅ | CH₃ |
| I.a.346 | F | H | F | H | F | F | C₂H₅ | CH₃ |
| I.a.347 | Cl | H | F | H | F | F | C₂H₅ | CH₃ |
| I.a.348 | CN | H | F | H | F | F | C₂H₅ | CH₃ |
| I.a.349 | F | F | F | H | F | F | C₂H₅ | CH₃ |
| I.a.350 | Cl | F | F | H | F | F | C₂H₅ | CH₃ |
| I.a.351 | F | Cl | F | H | F | F | C₂H₅ | CH₃ |
| I.a.352 | Cl | F | F | H | F | F | C₂H₅ | CH₃ |
| I.a.353 | CN | F | F | H | F | F | C₂H₅ | CH₃ |
| I.a.354 | F | CN | F | H | F | F | C₂H₅ | CH₃ |
| I.a.355 | CN | F | F | H | F | F | C₂H₅ | CH₃ |
| I.a.356 | F | F | H | F | F | F | C₂H₅ | CH₃ |
| I.a.357 | Cl | F | H | F | F | F | C₂H₅ | CH₃ |
| I.a.358 | F | Cl | H | F | F | F | C₂H₅ | CH₃ |
| I.a.359 | CN | F | H | F | F | F | C₂H₅ | CH₃ |
| I.a.360 | F | CN | H | F | F | F | C₂H₅ | CH₃ |
| I.a.361 | F | F | F | F | F | F | C₂H₅ | CH₃ |
| I.a.362 | Cl | F | F | F | F | F | C₂H₅ | CH₃ |
| I.a.363 | F | Cl | F | F | F | F | C₂H₅ | CH₃ |
| I.a.364 | CN | F | F | F | F | F | C₂H₅ | CH₃ |
| I.a.365 | F | CN | F | F | F | F | C₂H₅ | CH₃ |
| I.a.366 | H | F | F | F | F | F | C₂H₅ | CH₃ |
| I.a.367 | F | F | Br | F | F | F | C₂H₅ | CH₃ |
| I.a.368 | F | F | C≡CH | F | F | F | C₂H₅ | CH₃ |
| I.a.369 | CF₃ | Cl | H | H | F | F | C₂H₅ | CH₃ |
| I.a.370 | F | F | I | F | F | F | C₂H₅ | CH₃ |
| I.a.371 | F | H | H | H | F | F | C₂H₅ | C₂H₅ |
| I.a.372 | Cl | H | H | H | F | F | C₂H₅ | C₂H₅ |
| I.a.373 | Br | H | H | H | F | F | C₂H₅ | C₂H₅ |
| I.a.374 | CN | H | H | H | F | F | C₂H₅ | C₂H₅ |
| I.a.375 | CH₃ | H | H | H | F | F | C₂H₅ | C₂H₅ |
| I.a.376 | F | H | H | F | F | F | C₂H₅ | C₂H₅ |
| I.a.377 | Cl | H | H | F | F | F | C₂H₅ | C₂H₅ |
| I.a.378 | F | H | H | Cl | F | F | C₂H₅ | C₂H₅ |
| I.a.379 | Cl | H | H | F | F | F | C₂H₅ | C₂H₅ |
| I.a.380 | CN | H | H | F | F | F | C₂H₅ | C₂H₅ |
| I.a.381 | F | H | H | CN | F | F | C₂H₅ | C₂H₅ |
| I.a.382 | CN | H | H | F | F | F | C₂H₅ | C₂H₅ |
| I.a.383 | F | H | F | H | F | F | C₂H₅ | C₂H₅ |
| I.a.384 | Cl | H | F | H | F | F | C₂H₅ | C₂H₅ |
| I.a.385 | CN | H | F | H | F | F | C₂H₅ | C₂H₅ |
| I.a.386 | F | F | F | H | F | F | C₂H₅ | C₂H₅ |
| I.a.387 | Cl | F | F | H | F | F | C₂H₅ | C₂H₅ |
| I.a.388 | F | Cl | F | H | F | F | C₂H₅ | C₂H₅ |
| I.a.389 | Cl | F | F | H | F | F | C₂H₅ | C₂H₅ |
| I.a.390 | CN | F | F | H | F | F | C₂H₅ | C₂H₅ |
| I.a.391 | F | CN | F | H | F | F | C₂H₅ | C₂H₅ |
| I.a.392 | CN | F | F | H | F | F | C₂H₅ | C₂H₅ |
| I.a.393 | F | F | H | F | F | F | C₂H₅ | C₂H₅ |
| I.a.394 | Cl | F | H | F | F | F | C₂H₅ | C₂H₅ |
| I.a.395 | F | Cl | H | F | F | F | C₂H₅ | C₂H₅ |
| I.a.396 | CN | F | H | F | F | F | C₂H₅ | C₂H₅ |
| I.a.397 | F | CN | H | F | F | F | C₂H₅ | C₂H₅ |
| I.a.398 | F | F | F | F | F | F | C₂H₅ | C₂H₅ |
| I.a.399 | Cl | F | F | F | F | F | C₂H₅ | C₂H₅ |
| I.a.400 | F | Cl | F | F | F | F | C₂H₅ | C₂H₅ |
| I.a.401 | CN | F | F | F | F | F | C₂H₅ | C₂H₅ |
| I.a.402 | F | CN | F | F | F | F | C₂H₅ | C₂H₅ |
| I.a.403 | H | F | F | F | F | F | C₂H₅ | C₂H₅ |
| I.a.404 | F | F | Br | F | F | F | C₂H₅ | C₂H₅ |
| I.a.405 | F | F | C≡CH | F | F | F | C₂H₅ | C₂H₅ |
| I.a.406 | CF₃ | Cl | H | H | F | F | C₂H₅ | C₂H₅ |
| I.a.407 | F | F | I | F | F | F | C₂H₅ | C₂H₅ |
| I.a.408 | F | H | H | H | F | H | —(CH₂)₂— | |
| I.a.409 | Cl | H | H | H | F | H | —(CH₂)₂— | |
| I.a.410 | Br | H | H | H | F | H | —(CH₂)₂— | |
| I.a.411 | CN | H | H | H | F | H | —(CH₂)₂— | |
| I.a.412 | CH₃ | H | H | H | F | H | —(CH₂)₂— | |
| I.a.413 | F | H | H | F | F | H | —(CH₂)₂— | |
| I.a.414 | Cl | H | H | F | F | H | —(CH₂)₂— | |
| I.a.415 | F | H | H | Cl | F | H | —(CH₂)₂— | |
| I.a.416 | Cl | H | H | F | F | H | —(CH₂)₂— | |
| I.a.417 | CN | H | H | F | F | H | —(CH₂)₂— | |
| I.a.418 | F | H | H | CN | F | H | —(CH₂)₂— | |
| I.a.419 | CN | H | H | F | F | H | —(CH₂)₂— | |
| I.a.420 | F | H | F | H | F | H | —(CH₂)₂— | |
| I.a.421 | Cl | H | F | H | F | H | —(CH₂)₂— | |
| I.a.422 | CN | H | F | H | F | H | —(CH₂)₂— | |
| I.a.423 | F | F | F | H | F | H | —(CH₂)₂— | |
| I.a.424 | Cl | F | F | H | F | H | —(CH₂)₂— | |

TABLE A-continued

| No. | $R^a$ | $R^b$ | $R^c$ | $R^d$ | $R^e$ | $R^2$ | $R^3$ | $R^4$ |
|---|---|---|---|---|---|---|---|---|
| I.a.425 | F | Cl | F | H | F | H | | —(CH$_2$)$_2$— |
| I.a.426 | Cl | F | F | H | F | H | | —(CH$_2$)$_2$— |
| I.a.427 | CN | F | F | H | F | H | | —(CH$_2$)$_2$— |
| I.a.428 | F | CN | F | H | F | H | | —(CH$_2$)$_2$— |
| I.a.429 | CN | F | F | H | F | H | | —(CH$_2$)$_2$— |
| I.a.430 | F | F | H | F | F | H | | —(CH$_2$)$_2$— |
| I.a.431 | Cl | F | H | F | F | H | | —(CH$_2$)$_2$— |
| I.a.432 | F | Cl | H | F | F | H | | —(CH$_2$)$_2$— |
| I.a.433 | CN | F | H | F | F | H | | —(CH$_2$)$_2$— |
| I.a.434 | F | CN | H | F | F | H | | —(CH$_2$)$_2$— |
| I.a.435 | F | F | F | F | F | H | | —(CH$_2$)$_2$— |
| I.a.436 | Cl | F | F | F | F | H | | —(CH$_2$)$_2$— |
| I.a.437 | F | Cl | F | F | F | H | | —(CH$_2$)$_2$— |
| I.a.438 | CN | F | F | F | F | H | | —(CH$_2$)$_2$— |
| I.a.439 | F | CN | F | F | F | H | | —(CH$_2$)$_2$— |
| I.a.440 | H | F | F | F | F | H | | —(CH$_2$)$_2$— |
| I.a.441 | F | F | Br | F | F | H | | —(CH$_2$)$_2$— |
| I.a.442 | F | F | C≡CH | F | F | H | | —(CH$_2$)$_2$— |
| I.a.443 | CF3 | Cl | H | H | F | H | | —(CH$_2$)$_2$— |
| I.a.444 | F | F | I | F | F | H | | —(CH$_2$)$_2$— |
| I.a.445 | F | H | H | H | F | H | | —(CH$_2$)$_3$— |
| I.a.446 | Cl | H | H | H | F | H | | —(CH$_2$)$_3$— |
| I.a.447 | Br | H | H | H | F | H | | —(CH$_2$)$_3$— |
| I.a.448 | CN | H | H | H | F | H | | —(CH$_2$)$_3$— |
| I.a.449 | CH$_3$ | H | H | H | F | H | | —(CH$_2$)$_3$— |
| I.a.450 | F | H | H | F | F | H | | —(CH$_2$)$_3$— |
| I.a.451 | Cl | H | H | F | F | H | | —(CH$_2$)$_3$— |
| I.a.452 | F | H | H | Cl | F | H | | —(CH$_2$)$_3$— |
| I.a.453 | Cl | H | H | F | F | H | | —(CH$_2$)$_3$— |
| I.a.454 | CN | H | H | F | F | H | | —(CH$_2$)$_3$— |
| I.a.455 | F | H | H | CN | F | H | | —(CH$_2$)$_3$— |
| I.a.456 | CN | H | H | F | F | H | | —(CH$_2$)$_3$— |
| I.a.457 | F | H | F | H | F | H | | —(CH$_2$)$_3$— |
| I.a.458 | Cl | H | F | H | F | H | | —(CH$_2$)$_3$— |
| I.a.459 | CN | H | F | H | F | H | | —(CH$_2$)$_3$— |
| I.a.460 | F | F | F | H | F | H | | —(CH$_2$)$_3$— |
| I.a.461 | Cl | F | F | H | F | H | | —(CH$_2$)$_3$— |
| I.a.462 | F | Cl | F | H | F | H | | —(CH$_2$)$_3$— |
| I.a.463 | Cl | F | F | H | F | H | | —(CH$_2$)$_3$— |
| I.a.464 | CN | F | F | H | F | H | | —(CH$_2$)$_3$— |
| I.a.465 | F | CN | F | H | F | H | | —(CH$_2$)$_3$— |
| I.a.466 | CN | F | F | H | F | H | | —(CH$_2$)$_3$— |
| I.a.467 | F | F | H | F | F | H | | —(CH$_2$)$_3$— |
| I.a.468 | Cl | F | H | F | F | H | | —(CH$_2$)$_3$— |
| I.a.469 | F | Cl | H | F | F | H | | —(CH$_2$)$_3$— |
| I.a.470 | CN | F | H | F | F | H | | —(CH$_2$)$_3$— |
| I.a.471 | F | CN | H | F | F | H | | —(CH$_2$)$_3$— |
| I.a.472 | F | F | F | F | F | H | | —(CH$_2$)$_3$— |
| I.a.473 | Cl | F | F | F | F | H | | —(CH$_2$)$_3$— |
| I.a.474 | F | Cl | F | F | F | H | | —(CH$_2$)$_3$— |
| I.a.475 | CN | F | F | F | F | H | | —(CH$_2$)$_3$— |
| I.a.476 | F | CN | F | F | F | H | | —(CH$_2$)$_3$— |
| I.a.477 | H | F | F | F | F | H | | —(CH$_2$)$_3$— |
| I.a.478 | F | F | Br | F | F | H | | —(CH$_2$)$_3$— |
| I.a.479 | F | F | C≡CH | F | F | H | | —(CH$_2$)$_3$— |
| I.a.480 | CF$_3$ | Cl | H | H | F | H | | —(CH$_2$)$_3$— |
| I.a.481 | F | F | I | F | F | H | | —(CH$_2$)$_3$— |
| I.a.482 | F | H | H | H | F | H | | —(CH$_2$)$_4$— |
| I.a.483 | Cl | H | H | H | F | H | | —(CH$_2$)$_4$— |
| I.a.484 | Br | H | H | H | F | H | | —(CH$_2$)$_4$— |
| I.a.485 | CN | H | H | H | F | H | | —(CH$_2$)$_4$— |
| I.a.486 | CH$_3$ | H | H | H | F | H | | —(CH$_2$)$_4$— |
| I.a.487 | F | H | H | F | F | H | | —(CH$_2$)$_4$— |
| I.a.488 | Cl | H | H | F | F | H | | —(CH$_2$)$_4$— |
| I.a.489 | F | H | H | Cl | F | H | | —(CH$_2$)$_4$— |
| I.a.490 | Cl | H | H | F | F | H | | —(CH$_2$)$_4$— |
| I.a.491 | CN | H | H | F | F | H | | —(CH$_2$)$_4$— |
| I.a.492 | F | H | H | CN | F | H | | —(CH$_2$)$_4$— |
| I.a.493 | CN | H | H | F | F | H | | —(CH$_2$)$_4$— |
| I.a.494 | F | H | F | H | F | H | | —(CH$_2$)$_4$— |
| I.a.495 | Cl | H | F | H | F | H | | —(CH$_2$)$_4$— |
| I.a.496 | CN | H | F | H | F | H | | —(CH$_2$)$_4$— |
| I.a.497 | F | F | F | H | F | H | | —(CH$_2$)$_4$— |
| I.a.498 | Cl | F | F | H | F | H | | —(CH$_2$)$_4$— |
| I.a.499 | F | Cl | F | H | F | H | | —(CH$_2$)$_4$— |
| I.a.500 | Cl | F | F | H | F | H | | —(CH$_2$)$_4$— |
| I.a.501 | CN | F | F | H | F | H | | —(CH$_2$)$_4$— |
| I.a.502 | F | CN | F | H | F | H | | —(CH$_2$)$_4$— |
| I.a.503 | CN | F | F | H | F | H | | —(CH$_2$)$_4$— |
| I.a.504 | F | F | H | F | F | H | | —(CH$_2$)$_4$— |
| I.a.505 | Cl | F | H | F | F | H | | —(CH$_2$)$_4$— |
| I.a.506 | F | Cl | H | F | F | H | | —(CH$_2$)$_4$— |
| I.a.507 | CN | F | H | F | F | H | | —(CH$_2$)$_4$— |
| I.a.508 | F | CN | H | F | F | H | | —(CH$_2$)$_4$— |
| I.a.509 | F | F | F | F | F | H | | —(CH$_2$)$_4$— |
| I.a.510 | Cl | F | F | F | F | H | | —(CH$_2$)$_4$— |
| I.a.511 | F | Cl | F | F | F | H | | —(CH$_2$)$_4$— |
| I.a.512 | CN | F | F | F | F | H | | —(CH$_2$)$_4$— |
| I.a.513 | F | CN | F | F | F | H | | —(CH$_2$)$_4$— |
| I.a.514 | H | F | F | F | F | H | | —(CH$_2$)$_4$— |
| I.a.515 | F | F | Br | F | F | H | | —(CH$_2$)$_4$— |
| I.a.516 | F | F | C≡CH | F | F | H | | —(CH$_2$)$_4$— |
| I.a.517 | CF$_3$ | Cl | H | H | F | H | | —(CH$_2$)$_4$— |
| I.a.518 | F | F | I | F | F | H | | —(CH$_2$)$_4$— |
| I.a.519 | F | H | H | H | F | H | | —(CH$_2$)$_5$— |
| I.a.520 | Cl | H | H | H | F | H | | —(CH$_2$)$_5$— |
| I.a.521 | Br | H | H | H | F | H | | —(CH$_2$)$_5$— |
| I.a.522 | CN | H | H | H | F | H | | —(CH$_2$)$_5$— |
| I.a.523 | CH$_3$ | H | H | H | F | H | | —(CH$_2$)$_5$— |
| I.a.524 | F | H | H | F | F | H | | —(CH$_2$)$_5$— |
| I.a.525 | Cl | H | H | F | F | H | | —(CH$_2$)$_5$— |
| I.a.526 | F | H | H | Cl | F | H | | —(CH$_2$)$_5$— |
| I.a.527 | Cl | H | H | F | F | H | | —(CH$_2$)$_5$— |
| I.a.528 | CN | H | H | F | F | H | | —(CH$_2$)$_5$— |
| I.a.529 | F | H | H | CN | F | H | | —(CH$_2$)$_5$— |
| I.a.530 | CN | H | H | F | F | H | | —(CH$_2$)$_5$— |
| I.a.531 | F | H | F | H | F | H | | —(CH$_2$)$_5$— |
| I.a.532 | Cl | H | F | H | F | H | | —(CH$_2$)$_5$— |
| I.a.533 | CN | H | F | H | F | H | | —(CH$_2$)$_5$— |
| I.a.534 | F | F | F | H | F | H | | —(CH$_2$)$_5$— |
| I.a.535 | Cl | F | F | H | F | H | | —(CH$_2$)$_5$— |
| I.a.536 | F | Cl | F | H | F | H | | —(CH$_2$)$_5$— |
| I.a.537 | Cl | F | F | H | F | H | | —(CH$_2$)$_5$— |
| I.a.538 | CN | F | F | H | F | H | | —(CH$_2$)$_5$— |
| I.a.539 | F | CN | F | H | F | H | | —(CH$_2$)$_5$— |
| I.a.540 | CN | F | F | H | F | H | | —(CH$_2$)$_5$— |
| I.a.541 | F | F | H | F | F | H | | —(CH$_2$)$_5$— |
| I.a.542 | Cl | F | H | F | F | H | | —(CH$_2$)$_5$— |
| I.a.543 | F | Cl | H | F | F | H | | —(CH$_2$)$_5$— |
| I.a.544 | CN | F | H | F | F | H | | —(CH$_2$)$_5$— |
| I.a.545 | F | CN | H | F | F | H | | —(CH$_2$)$_5$— |
| I.a.546 | F | F | F | F | F | H | | —(CH$_2$)$_5$— |
| I.a.547 | Cl | F | F | F | F | H | | —(CH$_2$)$_5$— |
| I.a.548 | F | Cl | F | F | F | H | | —(CH$_2$)$_5$— |
| I.a.549 | CN | F | F | F | F | H | | —(CH$_2$)$_5$— |
| I.a.550 | F | CN | F | F | F | H | | —(CH$_2$)$_5$— |
| I.a.551 | H | F | F | F | F | H | | —(CH$_2$)$_5$— |
| I.a.552 | F | F | Br | F | F | H | | —(CH$_2$)$_5$— |
| I.a.553 | F | F | C≡CH | F | F | H | | —(CH$_2$)$_5$— |
| I.a.554 | CF$_3$ | Cl | H | H | F | H | | —(CH$_2$)$_5$— |
| I.a.555 | F | F | I | F | F | H | | —(CH$_2$)$_5$— |
| I.a.556 | F | H | H | H | F | CH$_3$ | | —(CH$_2$)$_2$— |
| I.a.557 | Cl | H | H | H | F | CH$_3$ | | —(CH$_2$)$_2$— |
| I.a.558 | Br | H | H | H | F | CH$_3$ | | —(CH$_2$)$_2$— |
| I.a.559 | CN | H | H | H | F | CH$_3$ | | —(CH$_2$)$_2$— |
| I.a.560 | CH$_3$ | H | H | H | F | CH$_3$ | | —(CH$_2$)$_2$— |
| I.a.561 | F | H | H | F | F | CH$_3$ | | —(CH$_2$)$_2$— |
| I.a.562 | Cl | H | H | F | F | CH$_3$ | | —(CH$_2$)$_2$— |
| I.a.563 | F | H | H | Cl | F | CH$_3$ | | —(CH$_2$)$_2$— |
| I.a.564 | Cl | H | H | F | F | CH$_3$ | | —(CH$_2$)$_2$— |
| I.a.565 | CN | H | H | F | F | CH$_3$ | | —(CH$_2$)$_2$— |
| I.a.566 | F | H | H | CN | F | CH$_3$ | | —(CH$_2$)$_2$— |
| I.a.567 | CN | H | H | F | F | CH$_3$ | | —(CH$_2$)$_2$— |
| I.a.568 | F | H | F | H | F | CH$_3$ | | —(CH$_2$)$_2$— |
| I.a.569 | Cl | H | F | H | F | CH$_3$ | | —(CH$_2$)$_2$— |
| I.a.570 | CN | H | F | H | F | CH$_3$ | | —(CH$_2$)$_2$— |
| I.a.571 | F | F | F | H | F | CH$_3$ | | —(CH$_2$)$_2$— |
| I.a.572 | Cl | F | F | H | F | CH$_3$ | | —(CH$_2$)$_2$— |
| I.a.573 | F | Cl | F | H | F | CH$_3$ | | —(CH$_2$)$_2$— |
| I.a.574 | Cl | F | F | H | F | CH$_3$ | | —(CH$_2$)$_2$— |
| I.a.575 | CN | F | F | H | F | CH$_3$ | | —(CH$_2$)$_2$— |
| I.a.576 | F | CN | F | H | F | CH$_3$ | | —(CH$_2$)$_2$— |
| I.a.577 | CN | F | F | H | F | CH$_3$ | | —(CH$_2$)$_2$— |
| I.a.578 | F | F | H | F | F | CH$_3$ | | —(CH$_2$)$_2$— |
| I.a.579 | Cl | F | H | F | F | CH$_3$ | | —(CH$_2$)$_2$— |
| I.a.580 | F | Cl | H | F | F | CH$_3$ | | —(CH$_2$)$_2$— |

TABLE A-continued

| No. | $R^a$ | $R^b$ | $R^c$ | $R^d$ | $R^e$ | $R^2$ | $R^3$ | $R^4$ |
|---|---|---|---|---|---|---|---|---|
| I.a.581 | CN | F | H | F | F | $CH_3$ | —$(CH_2)_2$— | |
| I.a.582 | F | CN | H | F | F | $CH_3$ | —$(CH_2)_2$— | |
| I.a.583 | F | F | F | F | F | $CH_3$ | —$(CH_2)_2$— | |
| I.a.584 | Cl | F | F | F | F | $CH_3$ | —$(CH_2)_2$— | |
| I.a.585 | F | Cl | F | F | F | $CH_3$ | —$(CH_2)_2$— | |
| I.a.586 | CN | F | F | F | F | $CH_3$ | —$(CH_2)_2$— | |
| I.a.587 | F | CN | F | F | F | $CH_3$ | —$(CH_2)_2$— | |
| I.a.588 | H | F | F | F | F | $CH_3$ | —$(CH_2)_2$— | |
| I.a.589 | F | F | Br | F | F | $CH_3$ | —$(CH_2)_2$— | |
| I.a.590 | F | F | C≡CH | F | F | $CH_3$ | —$(CH_2)_2$— | |
| I.a.591 | $CF_3$ | Cl | H | H | F | $CH_3$ | —$(CH_2)_2$— | |
| I.a.592 | F | F | I | F | F | $CH_3$ | —$(CH_2)_2$— | |
| I.a.593 | F | H | H | H | F | $CH_3$ | —$(CH_2)_3$— | |
| I.a.594 | Cl | H | H | H | F | $CH_3$ | —$(CH_2)_3$— | |
| I.a.595 | Br | H | H | H | F | $CH_3$ | —$(CH_2)_3$— | |
| I.a.596 | CN | H | H | H | F | $CH_3$ | —$(CH_2)_3$— | |
| I.a.597 | $CH_3$ | H | H | H | F | $CH_3$ | —$(CH_2)_3$— | |
| I.a.598 | F | H | H | F | F | $CH_3$ | —$(CH_2)_3$— | |
| I.a.599 | Cl | H | H | F | F | $CH_3$ | —$(CH_2)_3$— | |
| I.a.600 | F | H | H | Cl | F | $CH_3$ | —$(CH_2)_3$— | |
| I.a.601 | Cl | H | H | F | F | $CH_3$ | —$(CH_2)_3$— | |
| I.a.602 | CN | H | H | F | F | $CH_3$ | —$(CH_2)_3$— | |
| I.a.603 | F | H | H | CN | F | $CH_3$ | —$(CH_2)_3$— | |
| I.a.604 | CN | H | H | F | F | $CH_3$ | —$(CH_2)_3$— | |
| I.a.605 | F | H | F | H | F | $CH_3$ | —$(CH_2)_3$— | |
| I.a.606 | Cl | H | F | H | F | $CH_3$ | —$(CH_2)_3$— | |
| I.a.607 | CN | H | F | H | F | $CH_3$ | —$(CH_2)_3$— | |
| I.a.608 | F | F | F | H | F | $CH_3$ | —$(CH_2)_3$— | |
| I.a.609 | Cl | F | F | H | F | $CH_3$ | —$(CH_2)_3$— | |
| I.a.610 | F | Cl | F | H | F | $CH_3$ | —$(CH_2)_3$— | |
| I.a.611 | Cl | F | F | H | F | $CH_3$ | —$(CH_2)_3$— | |
| I.a.612 | CN | F | F | H | F | $CH_3$ | —$(CH_2)_3$— | |
| I.a.613 | F | CN | F | H | F | $CH_3$ | —$(CH_2)_3$— | |
| I.a.614 | CN | F | F | H | F | $CH_3$ | —$(CH_2)_3$— | |
| I.a.615 | F | F | H | F | F | $CH_3$ | —$(CH_2)_3$— | |
| I.a.616 | Cl | F | H | F | F | $CH_3$ | —$(CH_2)_3$— | |
| I.a.617 | F | Cl | H | F | F | $CH_3$ | —$(CH_2)_3$— | |
| I.a.618 | CN | F | H | F | F | $CH_3$ | —$(CH_2)_3$— | |
| I.a.619 | F | CN | H | F | F | $CH_3$ | —$(CH_2)_3$— | |
| I.a.620 | F | F | F | F | F | $CH_3$ | —$(CH_2)_3$— | |
| I.a.621 | Cl | F | F | F | F | $CH_3$ | —$(CH_2)_3$— | |
| I.a.622 | F | Cl | F | F | F | $CH_3$ | —$(CH_2)_3$— | |
| I.a.623 | CN | F | F | F | F | $CH_3$ | —$(CH_2)_3$— | |
| I.a.624 | F | CN | F | F | F | $CH_3$ | —$(CH_2)_3$— | |
| I.a.625 | H | F | F | F | F | $CH_3$ | —$(CH_2)_3$— | |
| I.a.626 | F | F | Br | F | F | $CH_3$ | —$(CH_2)_3$— | |
| I.a.627 | F | F | C≡CH | F | F | $CH_3$ | —$(CH_2)_3$— | |
| I.a.628 | $CF_3$ | Cl | H | H | F | $CH_3$ | —$(CH_2)_3$— | |
| I.a.629 | F | F | I | F | F | $CH_3$ | —$(CH_2)_3$— | |
| I.a.630 | F | H | H | H | F | $CH_3$ | —$(CH_2)_4$— | |
| I.a.631 | Cl | H | H | H | F | $CH_3$ | —$(CH_2)_4$— | |
| I.a.632 | Br | H | H | H | F | $CH_3$ | —$(CH_2)_4$— | |
| I.a.633 | CN | H | H | H | F | $CH_3$ | —$(CH_2)_4$— | |
| I.a.634 | $CH_3$ | H | H | H | F | $CH_3$ | —$(CH_2)_4$— | |
| I.a.635 | F | H | H | F | F | $CH_3$ | —$(CH_2)_4$— | |
| I.a.636 | Cl | H | H | F | F | $CH_3$ | —$(CH_2)_4$— | |
| I.a.637 | F | H | H | Cl | F | $CH_3$ | —$(CH_2)_4$— | |
| I.a.638 | Cl | H | H | F | F | $CH_3$ | —$(CH_2)_4$— | |
| I.a.639 | CN | H | H | F | F | $CH_3$ | —$(CH_2)_4$— | |
| I.a.640 | F | H | H | CN | F | $CH_3$ | —$(CH_2)_4$— | |
| I.a.641 | CN | H | H | F | F | $CH_3$ | —$(CH_2)_4$— | |
| I.a.642 | F | H | F | H | F | $CH_3$ | —$(CH_2)_4$— | |
| I.a.643 | Cl | H | F | H | F | $CH_3$ | —$(CH_2)_4$— | |
| I.a.644 | CN | H | F | H | F | $CH_3$ | —$(CH_2)_4$— | |
| I.a.645 | F | F | F | H | F | $CH_3$ | —$(CH_2)_4$— | |
| I.a.646 | Cl | F | F | H | F | $CH_3$ | —$(CH_2)_4$— | |
| I.a.647 | F | Cl | F | H | F | $CH_3$ | —$(CH_2)_4$— | |
| I.a.648 | Cl | F | F | H | F | $CH_3$ | —$(CH_2)_4$— | |
| I.a.649 | CN | F | F | H | F | $CH_3$ | —$(CH_2)_4$— | |
| I.a.650 | F | CN | F | H | F | $CH_3$ | —$(CH_2)_4$— | |
| I.a.651 | CN | F | F | H | F | $CH_3$ | —$(CH_2)_4$— | |
| I.a.652 | F | F | H | F | F | $CH_3$ | —$(CH_2)_4$— | |
| I.a.653 | Cl | F | H | F | F | $CH_3$ | —$(CH_2)_4$— | |
| I.a.654 | F | Cl | H | F | F | $CH_3$ | —$(CH_2)_4$— | |
| I.a.655 | CN | F | H | F | F | $CH_3$ | —$(CH_2)_4$— | |
| I.a.656 | F | CN | H | F | F | $CH_3$ | —$(CH_2)_4$— | |
| I.a.657 | F | F | F | F | F | $CH_3$ | —$(CH_2)_4$— | |
| I.a.658 | Cl | F | F | F | F | $CH_3$ | —$(CH_2)_4$— | |
| I.a.659 | F | Cl | F | F | F | $CH_3$ | —$(CH_2)_4$— | |
| I.a.660 | CN | F | F | F | F | $CH_3$ | —$(CH_2)_4$— | |
| I.a.661 | F | CN | F | F | F | $CH_3$ | —$(CH_2)_4$— | |
| I.a.662 | H | F | F | F | F | $CH_3$ | —$(CH_2)_4$— | |
| I.a.663 | F | F | Br | F | F | $CH_3$ | —$(CH_2)_4$— | |
| I.a.664 | F | F | C≡CH | F | F | $CH_3$ | —$(CH_2)_4$— | |
| I.a.665 | $CF_3$ | Cl | H | H | F | $CH_3$ | —$(CH_2)_4$— | |
| I.a.666 | F | H | I | F | F | $CH_3$ | —$(CH_2)_4$— | |
| I.a.667 | F | H | H | H | F | $CH_3$ | —$(CH_2)_5$— | |
| I.a.668 | Cl | H | H | H | F | $CH_3$ | —$(CH_2)_5$— | |
| I.a.669 | Br | H | H | H | F | $CH_3$ | —$(CH_2)_5$— | |
| I.a.670 | CN | H | H | H | F | $CH_3$ | —$(CH_2)_5$— | |
| I.a.671 | $CH_3$ | H | H | H | F | $CH_3$ | —$(CH_2)_5$— | |
| I.a.672 | F | H | H | F | F | $CH_3$ | —$(CH_2)_5$— | |
| I.a.673 | Cl | H | H | F | F | $CH_3$ | —$(CH_2)_5$— | |
| I.a.674 | F | H | H | Cl | F | $CH_3$ | —$(CH_2)_5$— | |
| I.a.675 | Cl | H | H | F | F | $CH_3$ | —$(CH_2)_5$— | |
| I.a.676 | CN | H | H | F | F | $CH_3$ | —$(CH_2)_5$— | |
| I.a.677 | F | H | H | CN | F | $CH_3$ | —$(CH_2)_5$— | |
| I.a.678 | CN | H | H | F | F | $CH_3$ | —$(CH_2)_5$— | |
| I.a.679 | F | H | F | H | F | $CH_3$ | —$(CH_2)_5$— | |
| I.a.680 | Cl | H | F | H | F | $CH_3$ | —$(CH_2)_5$— | |
| I.a.681 | CN | H | F | H | F | $CH_3$ | —$(CH_2)_5$— | |
| I.a.682 | F | F | F | H | F | $CH_3$ | —$(CH_2)_5$— | |
| I.a.683 | Cl | F | F | H | F | $CH_3$ | —$(CH_2)_5$— | |
| I.a.684 | F | Cl | F | H | F | $CH_3$ | —$(CH_2)_5$— | |
| I.a.685 | Cl | F | F | H | F | $CH_3$ | —$(CH_2)_5$— | |
| I.a.686 | CN | F | F | H | F | $CH_3$ | —$(CH_2)_5$— | |
| I.a.687 | F | CN | F | H | F | $CH_3$ | —$(CH_2)_5$— | |
| I.a.688 | CN | F | F | H | F | $CH_3$ | —$(CH_2)_5$— | |
| I.a.689 | F | F | H | F | F | $CH_3$ | —$(CH_2)_5$— | |
| I.a.690 | Cl | F | H | F | F | $CH_3$ | —$(CH_2)_5$— | |
| I.a.691 | F | Cl | H | F | F | $CH_3$ | —$(CH_2)_5$— | |
| I.a.692 | CN | F | H | F | F | $CH_3$ | —$(CH_2)_5$— | |
| I.a.693 | F | CN | H | F | F | $CH_3$ | —$(CH_2)_5$— | |
| I.a.694 | F | F | F | F | F | $CH_3$ | —$(CH_2)_5$— | |
| I.a.695 | Cl | F | F | F | F | $CH_3$ | —$(CH_2)_5$— | |
| I.a.696 | F | Cl | F | F | F | $CH_3$ | —$(CH_2)_5$— | |
| I.a.697 | CN | F | F | F | F | $CH_3$ | —$(CH_2)_5$— | |
| I.a.698 | F | CN | F | F | F | $CH_3$ | —$(CH_2)_5$— | |
| I.a.699 | H | F | F | F | F | $CH_3$ | —$(CH_2)_5$— | |
| I.a.700 | F | F | Br | F | F | $CH_3$ | —$(CH_2)_5$— | |
| I.a.701 | F | F | C≡CH | F | F | $CH_3$ | —$(CH_2)_5$— | |
| I.a.702 | $CF_3$ | Cl | H | H | F | $CH_3$ | —$(CH_2)_5$— | |
| I.a.703 | F | F | I | F | F | $CH_3$ | —$(CH_2)_5$— | |
| I.a.704 | F | H | H | H | F | F | —$(CH_2)_2$— | |
| I.a.705 | Cl | H | H | H | F | F | —$(CH_2)_2$— | |
| I.a.706 | Br | H | H | H | F | F | —$(CH_2)_2$— | |
| I.a.707 | CN | H | H | H | F | F | —$(CH_2)_2$— | |
| I.a.708 | $CH_3$ | H | H | H | F | F | —$(CH_2)_2$— | |
| I.a.709 | F | H | H | F | F | F | —$(CH_2)_2$— | |
| I.a.710 | Cl | H | H | F | F | F | —$(CH_2)_2$— | |
| I.a.711 | F | H | H | Cl | F | F | —$(CH_2)_2$— | |
| I.a.712 | Cl | H | H | F | F | F | —$(CH_2)_2$— | |
| I.a.713 | CN | H | H | F | F | F | —$(CH_2)_2$— | |
| I.a.714 | F | H | H | CN | F | F | —$(CH_2)_2$— | |
| I.a.715 | CN | H | H | F | F | F | —$(CH_2)_2$— | |
| I.a.716 | F | H | F | H | F | F | —$(CH_2)_2$— | |
| I.a.717 | Cl | H | F | H | F | F | —$(CH_2)_2$— | |
| I.a.718 | CN | H | F | H | F | F | —$(CH_2)_2$— | |
| I.a.719 | F | F | F | H | F | F | —$(CH_2)_2$— | |
| I.a.720 | Cl | F | F | H | F | F | —$(CH_2)_2$— | |
| I.a.721 | F | Cl | F | H | F | F | —$(CH_2)_2$— | |
| I.a.722 | Cl | F | F | H | F | F | —$(CH_2)_2$— | |
| I.a.723 | CN | F | F | H | F | F | —$(CH_2)_2$— | |
| I.a.724 | F | CN | F | H | F | F | —$(CH_2)_2$— | |
| I.a.725 | CN | F | F | H | F | F | —$(CH_2)_2$— | |
| I.a.726 | F | F | H | F | F | F | —$(CH_2)_2$— | |
| I.a.727 | Cl | F | H | F | F | F | —$(CH_2)_2$— | |
| I.a.728 | F | Cl | H | F | F | F | —$(CH_2)_2$— | |
| I.a.729 | CN | F | H | F | F | F | —$(CH_2)_2$— | |
| I.a.730 | F | CN | H | F | F | F | —$(CH_2)_2$— | |
| I.a.731 | F | F | F | F | F | F | —$(CH_2)_2$— | |
| I.a.732 | Cl | F | F | F | F | F | —$(CH_2)_2$— | |
| I.a.733 | F | Cl | F | F | F | F | —$(CH_2)_2$— | |
| I.a.734 | CN | F | F | F | F | F | —$(CH_2)_2$— | |
| I.a.735 | F | CN | F | F | F | F | —$(CH_2)_2$— | |
| I.a.736 | H | F | F | F | F | F | —$(CH_2)_2$— | |

TABLE A-continued

| No. | $R^a$ | $R^b$ | $R^c$ | $R^d$ | $R^e$ | $R^2$ | $R^3$ | $R^4$ |
|---|---|---|---|---|---|---|---|---|
| I.a.737 | F | F | Br | F | F | F | —(CH$_2$)$_2$— | |
| I.a.738 | F | F | C≡CH | F | F | F | —(CH$_2$)$_2$— | |
| I.a.739 | CF$_3$ | Cl | H | H | F | F | —(CH$_2$)$_2$— | |
| I.a.740 | F | F | I | F | F | F | —(CH$_2$)$_2$— | |
| I.a.741 | F | H | H | H | F | F | —(CH$_2$)$_3$— | |
| I.a.742 | Cl | H | H | H | F | F | —(CH$_2$)$_3$— | |
| I.a.743 | Br | H | H | H | F | F | —(CH$_2$)$_3$— | |
| I.a.744 | CN | H | H | H | F | F | —(CH$_2$)$_3$— | |
| I.a.745 | CH$_3$ | H | H | H | F | F | —(CH$_2$)$_3$— | |
| I.a.746 | F | H | H | F | F | F | —(CH$_2$)$_3$— | |
| I.a.747 | Cl | H | H | F | F | F | —(CH$_2$)$_3$— | |
| I.a.748 | F | H | H | Cl | F | F | —(CH$_2$)$_3$— | |
| I.a.749 | Cl | H | H | F | F | F | —(CH$_2$)$_3$— | |
| I.a.750 | CN | H | H | F | F | F | —(CH$_2$)$_3$— | |
| I.a.751 | F | H | H | CN | F | F | —(CH$_2$)$_3$— | |
| I.a.752 | CN | H | H | F | F | F | —(CH$_2$)$_3$— | |
| I.a.753 | F | H | F | H | F | F | —(CH$_2$)$_3$— | |
| I.a.754 | Cl | H | F | H | F | F | —(CH$_2$)$_3$— | |
| I.a.755 | CN | H | F | H | F | F | —(CH$_2$)$_3$— | |
| I.a.756 | F | F | F | H | F | F | —(CH$_2$)$_3$— | |
| I.a.757 | Cl | F | F | H | F | F | —(CH$_2$)$_3$— | |
| I.a.758 | F | Cl | F | H | F | F | —(CH$_2$)$_3$— | |
| I.a.759 | Cl | F | F | H | F | F | —(CH$_2$)$_3$— | |
| I.a.760 | CN | F | F | H | F | F | —(CH$_2$)$_3$— | |
| I.a.761 | F | CN | F | H | F | F | —(CH$_2$)$_3$— | |
| I.a.762 | CN | F | F | H | F | F | —(CH$_2$)$_3$— | |
| I.a.763 | F | F | H | F | F | F | —(CH$_2$)$_3$— | |
| I.a.764 | Cl | F | H | F | F | F | —(CH$_2$)$_3$— | |
| I.a.765 | F | Cl | H | F | F | F | —(CH$_2$)$_3$— | |
| I.a.766 | CN | F | H | F | F | F | —(CH$_2$)$_3$— | |
| I.a.767 | F | CN | H | F | F | F | —(CH$_2$)$_3$— | |
| I.a.768 | F | F | F | F | F | F | —(CH$_2$)$_3$— | |
| I.a.769 | Cl | F | F | F | F | F | —(CH$_2$)$_3$— | |
| I.a.770 | F | Cl | F | F | F | F | —(CH$_2$)$_3$— | |
| I.a.771 | CN | F | F | F | F | F | —(CH$_2$)$_3$— | |
| I.a.772 | F | CN | F | F | F | F | —(CH$_2$)$_3$— | |
| I.a.773 | H | F | F | F | F | F | —(CH$_2$)$_3$— | |
| I.a.774 | F | F | Br | F | F | F | —(CH$_2$)$_3$— | |
| I.a.775 | F | F | C≡CH | F | F | F | —(CH$_2$)$_3$— | |
| I.a.776 | CF$_3$ | Cl | H | H | F | F | —(CH$_2$)$_3$— | |
| I.a.777 | F | F | I | F | F | F | —(CH$_2$)$_3$— | |
| I.a.778 | F | H | H | H | F | F | —(CH$_2$)$_4$— | |
| I.a.779 | Cl | H | H | H | F | F | —(CH$_2$)$_4$— | |
| I.a.780 | Br | H | H | H | F | F | —(CH$_2$)$_4$— | |
| I.a.781 | CN | H | H | H | F | F | —(CH$_2$)$_4$— | |
| I.a.782 | CH$_3$ | H | H | H | F | F | —(CH$_2$)$_4$— | |
| I.a.783 | F | H | H | F | F | F | —(CH$_2$)$_4$— | |
| I.a.784 | Cl | H | H | F | F | F | —(CH$_2$)$_4$— | |
| I.a.785 | F | H | H | Cl | F | F | —(CH$_2$)$_4$— | |
| I.a.786 | Cl | H | H | F | F | F | —(CH$_2$)$_4$— | |
| I.a.787 | CN | H | H | F | F | F | —(CH$_2$)$_4$— | |
| I.a.788 | F | H | H | CN | F | F | —(CH$_2$)$_4$— | |
| I.a.789 | CN | H | H | F | F | F | —(CH$_2$)$_4$— | |
| I.a.790 | F | H | F | H | F | F | —(CH$_2$)$_4$— | |
| I.a.791 | Cl | H | F | H | F | F | —(CH$_2$)$_4$— | |
| I.a.792 | CN | H | F | H | F | F | —(CH$_2$)$_4$— | |
| I.a.793 | F | F | F | H | F | F | —(CH$_2$)$_4$— | |
| I.a.794 | Cl | F | F | H | F | F | —(CH$_2$)$_4$— | |
| I.a.795 | F | Cl | F | H | F | F | —(CH$_2$)$_4$— | |
| I.a.796 | Cl | F | F | H | F | F | —(CH$_2$)$_4$— | |
| I.a.797 | CN | F | F | H | F | F | —(CH$_2$)$_4$— | |
| I.a.798 | F | CN | F | H | F | F | —(CH$_2$)$_4$— | |
| I.a.799 | CN | F | F | H | F | F | —(CH$_2$)$_4$— | |
| I.a.800 | F | F | H | F | F | F | —(CH$_2$)$_4$— | |
| I.a.801 | Cl | F | H | F | F | F | —(CH$_2$)$_4$— | |
| I.a.802 | F | Cl | H | F | F | F | —(CH$_2$)$_4$— | |
| I.a.803 | CN | F | H | F | F | F | —(CH$_2$)$_4$— | |
| I.a.804 | F | CN | H | F | F | F | —(CH$_2$)$_4$— | |
| I.a.805 | F | F | F | F | F | F | —(CH$_2$)$_4$— | |
| I.a.806 | Cl | F | F | F | F | F | —(CH$_2$)$_4$— | |
| I.a.807 | F | Cl | F | F | F | F | —(CH$_2$)$_4$— | |
| I.a.808 | CN | F | F | F | F | F | —(CH$_2$)$_4$— | |
| I.a.809 | F | CN | F | F | F | F | —(CH$_2$)$_4$— | |
| I.a.810 | H | F | F | F | F | F | —(CH$_2$)$_4$— | |
| I.a.811 | F | F | Br | F | F | F | —(CH$_2$)$_4$— | |
| I.a.812 | F | F | C≡CH | F | F | F | —(CH$_2$)$_4$— | |
| I.a.813 | CF$_3$ | Cl | H | H | F | F | —(CH$_2$)$_4$— | |
| I.a.814 | F | F | I | F | F | F | —(CH$_2$)$_4$— | |
| I.a.815 | F | H | H | H | F | F | —(CH$_2$)$_5$— | |
| I.a.816 | Cl | H | H | H | F | F | —(CH$_2$)$_5$— | |
| I.a.817 | Br | H | H | H | F | F | —(CH$_2$)$_5$— | |
| I.a.818 | CN | H | H | H | F | F | —(CH$_2$)$_5$— | |
| I.a.819 | CH$_3$ | H | H | H | F | F | —(CH$_2$)$_5$— | |
| I.a.820 | F | H | H | F | F | F | —(CH$_2$)$_5$— | |
| I.a.821 | Cl | H | H | F | F | F | —(CH$_2$)$_5$— | |
| I.a.822 | F | H | H | Cl | F | F | —(CH$_2$)$_5$— | |
| I.a.823 | Cl | H | H | F | F | F | —(CH$_2$)$_5$— | |
| I.a.824 | CN | H | H | F | F | F | —(CH$_2$)$_5$— | |
| I.a.825 | F | H | H | CN | F | F | —(CH$_2$)$_5$— | |
| I.a.826 | CN | H | H | F | F | F | —(CH$_2$)$_5$— | |
| I.a.827 | F | H | F | H | F | F | —(CH$_2$)$_5$— | |
| I.a.828 | Cl | H | F | H | F | F | —(CH$_2$)$_5$— | |
| I.a.829 | CN | H | F | H | F | F | —(CH$_2$)$_5$— | |
| I.a.830 | F | F | F | H | F | F | —(CH$_2$)$_5$— | |
| I.a.831 | Cl | F | F | H | F | F | —(CH$_2$)$_5$— | |
| I.a.832 | F | Cl | F | H | F | F | —(CH$_2$)$_5$— | |
| I.a.833 | Cl | F | F | H | F | F | —(CH$_2$)$_5$— | |
| I.a.834 | CN | F | F | H | F | F | —(CH$_2$)$_5$— | |
| I.a.835 | F | CN | F | H | F | F | —(CH$_2$)$_5$— | |
| I.a.836 | CN | F | F | H | F | F | —(CH$_2$)$_5$— | |
| I.a.837 | F | F | H | F | F | F | —(CH$_2$)$_5$— | |
| I.a.838 | Cl | F | H | F | F | F | —(CH$_2$)$_5$— | |
| I.a.839 | F | Cl | H | F | F | F | —(CH$_2$)$_5$— | |
| I.a.840 | CN | F | H | F | F | F | —(CH$_2$)$_5$— | |
| I.a.841 | F | CN | H | F | F | F | —(CH$_2$)$_5$— | |
| I.a.842 | F | F | F | F | F | F | —(CH$_2$)$_5$— | |
| I.a.843 | Cl | F | F | F | F | F | —(CH$_2$)$_5$— | |
| I.a.844 | F | Cl | F | F | F | F | —(CH$_2$)$_5$— | |
| I.a.845 | CN | F | F | F | F | F | —(CH$_2$)$_5$— | |
| I.a.846 | F | CN | F | F | F | F | —(CH$_2$)$_5$— | |
| I.a.847 | H | F | F | F | F | F | —(CH$_2$)$_5$— | |
| I.a.848 | F | F | Br | F | F | F | —(CH$_2$)$_5$— | |
| I.a.849 | F | F | C≡CH | F | F | F | —(CH$_2$)$_5$— | |
| I.a.850 | CF$_3$ | Cl | H | H | F | F | —(CH$_2$)$_5$— | |
| I.a.851 | F | F | I | F | F | F | —(CH$_2$)$_5$— | |
| I.a.852 | F | H | H | H | F | Cl | —(CH$_2$)$_2$— | |
| I.a.853 | Cl | H | H | H | F | Cl | —(CH$_2$)$_2$— | |
| I.a.854 | Br | H | H | H | F | Cl | —(CH$_2$)$_2$— | |
| I.a.855 | CN | H | H | H | F | Cl | —(CH$_2$)$_2$— | |
| I.a.856 | CH$_3$ | H | H | H | F | Cl | —(CH$_2$)$_2$— | |
| I.a.857 | F | H | H | F | F | Cl | —(CH$_2$)$_2$— | |
| I.a.858 | Cl | H | H | F | F | Cl | —(CH$_2$)$_2$— | |
| I.a.859 | F | H | H | Cl | F | Cl | —(CH$_2$)$_2$— | |
| I.a.860 | Cl | H | H | F | F | Cl | —(CH$_2$)$_2$— | |
| I.a.861 | CN | H | H | F | F | Cl | —(CH$_2$)$_2$— | |
| I.a.862 | F | H | H | CN | F | Cl | —(CH$_2$)$_2$— | |
| I.a.863 | CN | H | H | F | F | Cl | —(CH$_2$)$_2$— | |
| I.a.864 | F | H | F | H | F | Cl | —(CH$_2$)$_2$— | |
| I.a.865 | Cl | H | F | H | F | Cl | —(CH$_2$)$_2$— | |
| I.a.866 | CN | H | F | H | F | Cl | —(CH$_2$)$_2$— | |
| I.a.867 | F | F | F | H | F | Cl | —(CH$_2$)$_2$— | |
| I.a.868 | Cl | F | F | H | F | Cl | —(CH$_2$)$_2$— | |
| I.a.869 | F | Cl | F | H | F | Cl | —(CH$_2$)$_2$— | |
| I.a.870 | Cl | F | F | H | F | Cl | —(CH$_2$)$_2$— | |
| I.a.871 | CN | F | F | H | F | Cl | —(CH$_2$)$_2$— | |
| I.a.872 | F | CN | F | H | F | Cl | —(CH$_2$)$_2$— | |
| I.a.873 | CN | F | F | H | F | Cl | —(CH$_2$)$_2$— | |
| I.a.874 | F | F | H | F | F | Cl | —(CH$_2$)$_2$— | |
| I.a.875 | Cl | F | H | F | F | Cl | —(CH$_2$)$_2$— | |
| I.a.876 | F | Cl | H | F | F | Cl | —(CH$_2$)$_2$— | |
| I.a.877 | CN | F | H | F | F | Cl | —(CH$_2$)$_2$— | |
| I.a.878 | F | CN | H | F | F | Cl | —(CH$_2$)$_2$— | |
| I.a.879 | F | F | F | F | F | Cl | —(CH$_2$)$_2$— | |
| I.a.880 | Cl | F | F | F | F | Cl | —(CH$_2$)$_2$— | |
| I.a.881 | F | Cl | F | F | F | Cl | —(CH$_2$)$_2$— | |
| I.a.882 | CN | F | F | F | F | Cl | —(CH$_2$)$_2$— | |
| I.a.883 | F | CN | F | F | F | Cl | —(CH$_2$)$_2$— | |
| I.a.884 | H | F | F | F | F | Cl | —(CH$_2$)$_2$— | |
| I.a.885 | F | F | Br | F | F | Cl | —(CH$_2$)$_2$— | |
| I.a.886 | F | F | C≡CH | F | F | Cl | —(CH$_2$)$_2$— | |
| I.a.887 | CF$_3$ | Cl | H | H | F | Cl | —(CH$_2$)$_2$— | |
| I.a.888 | F | F | I | F | F | Cl | —(CH$_2$)$_2$— | |
| I.a.889 | F | H | H | H | F | Cl | —(CH$_2$)$_3$— | |
| I.a.890 | Cl | H | H | H | F | Cl | —(CH$_2$)$_3$— | |
| I.a.891 | Br | H | H | H | F | Cl | —(CH$_2$)$_3$— | |
| I.a.892 | CN | H | H | H | F | Cl | —(CH$_2$)$_3$— | |

TABLE A-continued

| No. | $R^a$ | $R^b$ | $R^c$ | $R^d$ | $R^e$ | $R^2$ | $R^3$ | $R^4$ |
|---|---|---|---|---|---|---|---|---|
| I.a.893 | CH₃ | H | H | H | F | Cl | —(CH₂)₃— | |
| I.a.894 | F | H | H | F | F | Cl | —(CH₂)₃— | |
| I.a.895 | Cl | H | H | F | F | Cl | —(CH₂)₃— | |
| I.a.896 | F | H | H | Cl | F | Cl | —(CH₂)₃— | |
| I.a.897 | Cl | H | H | F | F | Cl | —(CH₂)₃— | |
| I.a.898 | CN | H | H | F | F | Cl | —(CH₂)₃— | |
| I.a.899 | F | H | H | CN | F | Cl | —(CH₂)₃— | |
| I.a.900 | CN | H | H | F | F | Cl | —(CH₂)₃— | |
| I.a.901 | F | H | F | H | F | Cl | —(CH₂)₃— | |
| I.a.902 | Cl | H | F | H | F | Cl | —(CH₂)₃— | |
| I.a.903 | CN | H | F | H | F | Cl | —(CH₂)₃— | |
| I.a.904 | F | F | F | H | F | Cl | —(CH₂)₃— | |
| I.a.905 | Cl | F | F | H | F | Cl | —(CH₂)₃— | |
| I.a.906 | F | Cl | F | H | F | Cl | —(CH₂)₃— | |
| I.a.907 | Cl | F | F | H | F | Cl | —(CH₂)₃— | |
| I.a.908 | CN | F | F | H | F | Cl | —(CH₂)₃— | |
| I.a.909 | F | CN | F | H | F | Cl | —(CH₂)₃— | |
| I.a.910 | CN | F | F | H | F | Cl | —(CH₂)₃— | |
| I.a.911 | F | F | H | F | F | Cl | —(CH₂)₃— | |
| I.a.912 | Cl | F | H | F | F | Cl | —(CH₂)₃— | |
| I.a.913 | F | Cl | H | F | F | Cl | —(CH₂)₃— | |
| I.a.914 | CN | F | H | F | F | Cl | —(CH₂)₃— | |
| I.a.915 | F | CN | H | F | F | Cl | —(CH₂)₃— | |
| I.a.916 | F | F | F | F | F | Cl | —(CH₂)₃— | |
| I.a.917 | Cl | F | F | F | F | Cl | —(CH₂)₃— | |
| I.a.918 | F | Cl | F | F | F | Cl | —(CH₂)₃— | |
| I.a.919 | CN | F | F | F | F | Cl | —(CH₂)₃— | |
| I.a.920 | F | CN | F | F | F | Cl | —(CH₂)₃— | |
| I.a.921 | H | F | F | F | F | Cl | —(CH₂)₃— | |
| I.a.922 | F | F | Br | F | F | Cl | —(CH₂)₃— | |
| I.a.923 | F | F | C≡CH | F | F | Cl | —(CH₂)₃— | |
| I.a.924 | CF₃ | Cl | H | H | F | Cl | —(CH₂)₃— | |
| I.a.925 | F | F | I | F | F | Cl | —(CH₂)₃— | |
| I.a.926 | F | H | H | H | F | Cl | —(CH₂)₄— | |
| I.a.927 | Cl | H | H | H | F | Cl | —(CH₂)₄— | |
| I.a.928 | Br | H | H | H | F | Cl | —(CH₂)₄— | |
| I.a.929 | CN | H | H | H | F | Cl | —(CH₂)₄— | |
| I.a.930 | CH₃ | H | H | H | F | Cl | —(CH₂)₄— | |
| I.a.931 | F | H | H | F | F | Cl | —(CH₂)₄— | |
| I.a.932 | Cl | H | H | F | F | Cl | —(CH₂)₄— | |
| I.a.933 | F | H | H | Cl | F | Cl | —(CH₂)₄— | |
| I.a.934 | Cl | H | H | F | F | Cl | —(CH₂)₄— | |
| I.a.935 | CN | H | H | F | F | Cl | —(CH₂)₄— | |
| I.a.936 | F | H | H | CN | F | Cl | —(CH₂)₄— | |
| I.a.937 | CN | H | H | F | F | Cl | —(CH₂)₄— | |
| I.a.938 | F | H | F | H | F | Cl | —(CH₂)₄— | |
| I.a.939 | Cl | H | F | H | F | Cl | —(CH₂)₄— | |
| I.a.940 | CN | H | F | H | F | Cl | —(CH₂)₄— | |
| I.a.941 | F | F | F | H | F | Cl | —(CH₂)₄— | |
| I.a.942 | Cl | F | F | H | F | Cl | —(CH₂)₄— | |
| I.a.943 | F | Cl | F | H | F | Cl | —(CH₂)₄— | |
| I.a.944 | Cl | F | F | H | F | Cl | —(CH₂)₄— | |
| I.a.945 | CN | F | F | H | F | Cl | —(CH₂)₄— | |
| I.a.946 | F | CN | F | H | F | Cl | —(CH₂)₄— | |
| I.a.947 | CN | F | F | H | F | Cl | —(CH₂)₄— | |
| I.a.948 | F | F | H | F | F | Cl | —(CH₂)₄— | |
| I.a.949 | Cl | F | H | F | F | Cl | —(CH₂)₄— | |
| I.a.950 | F | Cl | H | F | F | Cl | —(CH₂)₄— | |
| I.a.951 | CN | F | H | F | F | Cl | —(CH₂)₄— | |
| I.a.952 | F | CN | H | F | F | Cl | —(CH₂)₄— | |
| I.a.953 | F | F | F | F | F | Cl | —(CH₂)₄— | |
| I.a.954 | Cl | F | F | F | F | Cl | —(CH₂)₄— | |
| I.a.955 | F | Cl | F | F | F | Cl | —(CH₂)₄— | |
| I.a.956 | CN | F | F | F | F | Cl | —(CH₂)₄— | |
| I.a.957 | F | CN | F | F | F | Cl | —(CH₂)₄— | |
| I.a.958 | H | F | F | F | F | Cl | —(CH₂)₄— | |
| I.a.959 | F | F | Br | F | F | Cl | —(CH₂)₄— | |
| I.a.960 | F | F | C≡CH | F | F | Cl | —(CH₂)₄— | |
| I.a.961 | CF₃ | Cl | H | H | F | Cl | —(CH₂)₄— | |
| I.a.962 | F | F | I | F | F | Cl | —(CH₂)₄— | |
| I.a.963 | F | H | H | H | F | Cl | —(CH₂)₅— | |
| I.a.964 | Cl | H | H | H | F | Cl | —(CH₂)₅— | |
| I.a.965 | Br | H | H | H | F | Cl | —(CH₂)₅— | |
| I.a.966 | CN | H | H | H | F | Cl | —(CH₂)₅— | |
| I.a.967 | CH₃ | H | H | H | F | Cl | —(CH₂)₅— | |
| I.a.968 | F | H | H | F | F | Cl | —(CH₂)₅— | |
| I.a.969 | Cl | H | H | F | F | Cl | —(CH₂)₅— | |
| I.a.970 | F | H | H | Cl | F | Cl | —(CH₂)₅— | |
| I.a.971 | Cl | H | H | F | F | Cl | —(CH₂)₅— | |
| I.a.972 | CN | H | H | F | F | Cl | —(CH₂)₅— | |
| I.a.973 | F | H | H | CN | F | Cl | —(CH₂)₅— | |
| I.a.974 | CN | H | H | F | F | Cl | —(CH₂)₅— | |
| I.a.975 | F | H | F | H | F | Cl | —(CH₂)₅— | |
| I.a.976 | Cl | H | F | H | F | Cl | —(CH₂)₅— | |
| I.a.977 | CN | H | F | H | F | Cl | —(CH₂)₅— | |
| I.a.978 | F | F | F | H | F | Cl | —(CH₂)₅— | |
| I.a.979 | Cl | F | F | H | F | Cl | —(CH₂)₅— | |
| I.a.980 | F | Cl | F | H | F | Cl | —(CH₂)₅— | |
| I.a.981 | Cl | F | F | H | F | Cl | —(CH₂)₅— | |
| I.a.982 | CN | F | F | H | F | Cl | —(CH₂)₅— | |
| I.a.983 | F | CN | F | H | F | Cl | —(CH₂)₅— | |
| I.a.984 | CN | F | F | H | F | Cl | —(CH₂)₅— | |
| I.a.985 | F | F | H | F | F | Cl | —(CH₂)₅— | |
| I.a.986 | Cl | F | H | F | F | Cl | —(CH₂)₅— | |
| I.a.987 | F | Cl | H | F | F | Cl | —(CH₂)₅— | |
| I.a.988 | CN | F | H | F | F | Cl | —(CH₂)₅— | |
| I.a.989 | F | CN | H | F | F | Cl | —(CH₂)₅— | |
| I.a.990 | F | F | F | F | F | Cl | —(CH₂)₅— | |
| I.a.991 | Cl | F | F | F | F | Cl | —(CH₂)₅— | |
| I.a.992 | F | Cl | F | F | F | Cl | —(CH₂)₅— | |
| I.a.993 | CN | F | F | F | F | Cl | —(CH₂)₅— | |
| I.a.994 | F | CN | F | F | F | Cl | —(CH₂)₅— | |
| I.a.995 | H | F | F | F | F | Cl | —(CH₂)₅— | |
| I.a.996 | F | F | Br | F | F | Cl | —(CH₂)₅— | |
| I.a.997 | F | F | C≡CH | F | F | Cl | —(CH₂)₅— | |
| I.a.998 | CF₃ | Cl | H | H | F | Cl | —(CH₂)₅— | |
| I.a.999 | F | F | I | F | F | Cl | —(CH₂)₅— | |
| I.a.1000 | F | H | H | H | F | C₂H₅ | CH₃ | H |
| I.a.1001 | Cl | H | H | H | F | C₂H₅ | CH₃ | H |
| I.a.1002 | Br | H | H | H | F | C₂H₅ | CH₃ | H |
| I.a.1003 | CN | H | H | H | F | C₂H₅ | CH₃ | H |
| I.a.1004 | CH₃ | H | H | H | F | C₂H₅ | CH₃ | H |
| I.a.1005 | F | H | H | F | F | C₂H₅ | CH₃ | H |
| I.a.1006 | Cl | H | H | F | F | C₂H₅ | CH₃ | H |
| I.a.1007 | F | H | H | Cl | F | C₂H₅ | CH₃ | H |
| I.a.1008 | Cl | H | H | F | F | C₂H₅ | CH₃ | H |
| I.a.1009 | CN | H | H | F | F | C₂H₅ | CH₃ | H |
| I.a.1010 | F | H | H | CN | F | C₂H₅ | CH₃ | H |
| I.a.1011 | CN | H | H | F | F | C₂H₅ | CH₃ | H |
| I.a.1012 | F | H | F | H | F | C₂H₅ | CH₃ | H |
| I.a.1013 | Cl | H | F | H | F | C₂H₅ | CH₃ | H |
| I.a.1014 | CN | H | F | H | F | C₂H₅ | CH₃ | H |
| I.a.1015 | F | F | F | H | F | C₂H₅ | CH₃ | H |
| I.a.1016 | Cl | F | F | H | F | C₂H₅ | CH₃ | H |
| I.a.1017 | F | Cl | F | H | F | C₂H₅ | CH₃ | H |
| I.a.1018 | Cl | F | F | H | F | C₂H₅ | CH₃ | H |
| I.a.1019 | CN | F | F | H | F | C₂H₅ | CH₃ | H |
| I.a.1020 | F | CN | F | H | F | C₂H₅ | CH₃ | H |
| I.a.1021 | CN | F | F | H | F | C₂H₅ | CH₃ | H |
| I.a.1022 | F | F | H | F | F | C₂H₅ | CH₃ | H |
| I.a.1023 | Cl | F | H | F | F | C₂H₅ | CH₃ | H |
| I.a.1024 | F | Cl | H | F | F | C₂H₅ | CH₃ | H |
| I.a.1025 | CN | F | H | F | F | C₂H₅ | CH₃ | H |
| I.a.1026 | F | CN | H | F | F | C₂H₅ | CH₃ | H |
| I.a.1027 | F | F | F | F | F | C₂H₅ | CH₃ | H |
| I.a.1028 | Cl | F | F | F | F | C₂H₅ | CH₃ | H |
| I.a.1029 | F | Cl | F | F | F | C₂H₅ | CH₃ | H |
| I.a.1030 | CN | F | F | F | F | C₂H₅ | CH₃ | H |
| I.a.1031 | F | CN | F | F | F | C₂H₅ | CH₃ | H |
| I.a.1032 | H | F | F | F | F | C₂H₅ | CH₃ | H |
| I.a.1033 | F | F | Br | F | F | C₂H₅ | CH₃ | H |
| I.a.1034 | F | F | C≡CH | F | F | C₂H₅ | CH₃ | H |
| I.a.1035 | CF₃ | Cl | H | H | F | C₂H₅ | CH₃ | H |
| I.a.1036 | F | F | I | F | F | C₂H₅ | CH₃ | H |
| I.a.1037 | F | H | H | H | F | C₂H₅ | C₂H₅ | H |
| I.a.1038 | Cl | H | H | H | F | C₂H₅ | C₂H₅ | H |
| I.a.1039 | Br | H | H | H | F | C₂H₅ | C₂H₅ | H |
| I.a.1040 | CN | H | H | H | F | C₂H₅ | C₂H₅ | H |
| I.a.1041 | CH₃ | H | H | H | F | C₂H₅ | C₂H₅ | H |
| I.a.1042 | F | H | H | F | F | C₂H₅ | C₂H₅ | H |
| I.a.1043 | Cl | H | H | F | F | C₂H₅ | C₂H₅ | H |
| I.a.1044 | F | H | H | Cl | F | C₂H₅ | C₂H₅ | H |
| I.a.1045 | Cl | H | H | F | F | C₂H₅ | C₂H₅ | H |
| I.a.1046 | CN | H | H | F | F | C₂H₅ | C₂H₅ | H |
| I.a.1047 | F | H | H | CN | F | C₂H₅ | C₂H₅ | H |
| I.a.1048 | CN | H | H | F | F | C₂H₅ | C₂H₅ | H |

TABLE A-continued

| No. | $R^a$ | $R^b$ | $R^c$ | $R^d$ | $R^e$ | $R^2$ | $R^3$ | $R^4$ |
|---|---|---|---|---|---|---|---|---|
| I.a.1049 | F | H | F | H | F | $C_2H_5$ | $C_2H_5$ | H |
| I.a.1050 | Cl | H | F | H | F | $C_2H_5$ | $C_2H_5$ | H |
| I.a.1051 | CN | H | F | H | F | $C_2H_5$ | $C_2H_5$ | H |
| I.a.1052 | F | F | F | H | F | $C_2H_5$ | $C_2H_5$ | H |
| I.a.1053 | Cl | F | F | H | F | $C_2H_5$ | $C_2H_5$ | H |
| I.a.1054 | F | Cl | F | H | F | $C_2H_5$ | $C_2H_5$ | H |
| I.a.1055 | Cl | F | F | H | F | $C_2H_5$ | $C_2H_5$ | H |
| I.a.1056 | CN | F | F | H | F | $C_2H_5$ | $C_2H_5$ | H |
| I.a.1057 | F | CN | F | H | F | $C_2H_5$ | $C_2H_5$ | H |
| I.a.1058 | CN | F | F | H | F | $C_2H_5$ | $C_2H_5$ | H |
| I.a.1059 | F | F | H | F | F | $C_2H_5$ | $C_2H_5$ | H |
| I.a.1060 | Cl | F | H | F | F | $C_2H_5$ | $C_2H_5$ | H |
| I.a.1061 | F | Cl | H | F | F | $C_2H_5$ | $C_2H_5$ | H |
| I.a.1062 | CN | F | H | F | F | $C_2H_5$ | $C_2H_5$ | H |
| I.a.1063 | F | CN | H | F | F | $C_2H_5$ | $C_2H_5$ | H |
| I.a.1064 | F | F | F | F | F | $C_2H_5$ | $C_2H_5$ | H |
| I.a.1065 | Cl | F | F | F | F | $C_2H_5$ | $C_2H_5$ | H |
| I.a.1066 | F | Cl | F | F | F | $C_2H_5$ | $C_2H_5$ | H |
| I.a.1067 | CN | F | F | F | F | $C_2H_5$ | $C_2H_5$ | H |
| I.a.1068 | F | CN | F | F | F | $C_2H_5$ | $C_2H_5$ | H |
| I.a.1069 | H | F | F | F | F | $C_2H_5$ | $C_2H_5$ | H |
| I.a.1070 | F | F | Br | F | F | $C_2H_5$ | $C_2H_5$ | H |
| I.a.1071 | F | F | C≡CH | F | F | $C_2H_5$ | $C_2H_5$ | H |
| I.a.1072 | $CF_3$ | Cl | H | H | F | $C_2H_5$ | $C_2H_5$ | H |
| I.a.1073 | F | F | I | F | F | $C_2H_5$ | $C_2H_5$ | H |
| I.a.1074 | F | H | H | H | F | $C_2H_5$ | $C_2H_5$ | $CH_3$ |
| I.a.1075 | Cl | H | H | H | F | $C_2H_5$ | $C_2H_5$ | $CH_3$ |
| I.a.1076 | Br | H | H | H | F | $C_2H_5$ | $C_2H_5$ | $CH_3$ |
| I.a.1077 | CN | H | H | H | F | $C_2H_5$ | $C_2H_5$ | $CH_3$ |
| I.a.1078 | $CH_3$ | H | H | H | F | $C_2H_5$ | $C_2H_5$ | $CH_3$ |
| I.a.1079 | F | H | H | F | F | $C_2H_5$ | $C_2H_5$ | $CH_3$ |
| I.a.1080 | Cl | H | H | F | F | $C_2H_5$ | $C_2H_5$ | $CH_3$ |
| I.a.1081 | F | H | H | Cl | F | $C_2H_5$ | $C_2H_5$ | $CH_3$ |
| I.a.1082 | Cl | H | H | F | F | $C_2H_5$ | $C_2H_5$ | $CH_3$ |
| I.a.1083 | CN | H | H | F | F | $C_2H_5$ | $C_2H_5$ | $CH_3$ |
| I.a.1084 | F | H | H | CN | F | $C_2H_5$ | $C_2H_5$ | $CH_3$ |
| I.a.1085 | CN | H | H | F | F | $C_2H_5$ | $C_2H_5$ | $CH_3$ |
| I.a.1086 | F | H | F | H | F | $C_2H_5$ | $C_2H_5$ | $CH_3$ |
| I.a.1087 | Cl | H | F | H | F | $C_2H_5$ | $C_2H_5$ | $CH_3$ |
| I.a.1088 | CN | H | F | H | F | $C_2H_5$ | $C_2H_5$ | $CH_3$ |
| I.a.1089 | F | F | F | H | F | $C_2H_5$ | $C_2H_5$ | $CH_3$ |
| I.a.1090 | Cl | F | F | H | F | $C_2H_5$ | $C_2H_5$ | $CH_3$ |
| I.a.1091 | F | Cl | F | H | F | $C_2H_5$ | $C_2H_5$ | $CH_3$ |
| I.a.1092 | Cl | F | F | H | F | $C_2H_5$ | $C_2H_5$ | $CH_3$ |
| I.a.1093 | CN | F | F | H | F | $C_2H_5$ | $C_2H_5$ | $CH_3$ |
| I.a.1094 | F | CN | F | H | F | $C_2H_5$ | $C_2H_5$ | $CH_3$ |
| I.a.1095 | CN | F | F | H | F | $C_2H_5$ | $C_2H_5$ | $CH_3$ |
| I.a.1096 | F | F | H | F | F | $C_2H_5$ | $C_2H_5$ | $CH_3$ |
| I.a.1097 | Cl | F | H | F | F | $C_2H_5$ | $C_2H_5$ | $CH_3$ |
| I.a.1098 | F | Cl | H | F | F | $C_2H_5$ | $C_2H_5$ | $CH_3$ |
| I.a.1099 | CN | F | H | F | F | $C_2H_5$ | $C_2H_5$ | $CH_3$ |
| I.a.1100 | F | CN | H | F | F | $C_2H_5$ | $C_2H_5$ | $CH_3$ |
| I.a.1101 | F | F | F | F | F | $C_2H_5$ | $C_2H_5$ | $CH_3$ |
| I.a.1102 | Cl | F | F | F | F | $C_2H_5$ | $C_2H_5$ | $CH_3$ |
| I.a.1103 | F | Cl | F | F | F | $C_2H_5$ | $C_2H_5$ | $CH_3$ |
| I.a.1104 | CN | F | F | F | F | $C_2H_5$ | $C_2H_5$ | $CH_3$ |
| I.a.1105 | F | CN | F | F | F | $C_2H_5$ | $C_2H_5$ | $CH_3$ |
| I.a.1106 | H | F | F | F | F | $C_2H_5$ | $C_2H_5$ | $CH_3$ |
| I.a.1107 | F | F | Br | F | F | $C_2H_5$ | $C_2H_5$ | $CH_3$ |
| I.a.1108 | F | F | C≡CH | F | F | $C_2H_5$ | $C_2H_5$ | $CH_3$ |
| I.a.1109 | $CF_3$ | Cl | H | H | F | $C_2H_5$ | $C_2H_5$ | $CH_3$ |
| I.a.1110 | F | F | I | F | F | $C_2H_5$ | $C_2H_5$ | $CH_3$ |
| I.a.1111 | F | H | H | H | F | $C_2H_5$ | $CH_3$ | $CH_3$ |
| I.a.1112 | Cl | H | H | H | F | $C_2H_5$ | $CH_3$ | $CH_3$ |
| I.a.1113 | Br | H | H | H | F | $C_2H_5$ | $CH_3$ | $CH_3$ |
| I.a.1114 | CN | H | H | H | F | $C_2H_5$ | $CH_3$ | $CH_3$ |
| I.a.1115 | $CH_3$ | H | H | H | F | $C_2H_5$ | $CH_3$ | $CH_3$ |
| I.a.1116 | F | H | H | F | F | $C_2H_5$ | $CH_3$ | $CH_3$ |
| I.a.1117 | Cl | H | H | F | F | $C_2H_5$ | $CH_3$ | $CH_3$ |
| I.a.1118 | F | H | H | Cl | F | $C_2H_5$ | $CH_3$ | $CH_3$ |
| I.a.1119 | Cl | H | H | F | F | $C_2H_5$ | $CH_3$ | $CH_3$ |
| I.a.1120 | CN | H | H | F | F | $C_2H_5$ | $CH_3$ | $CH_3$ |
| I.a.1121 | F | H | H | CN | F | $C_2H_5$ | $CH_3$ | $CH_3$ |
| I.a.1122 | CN | H | H | F | F | $C_2H_5$ | $CH_3$ | $CH_3$ |
| I.a.1123 | F | H | F | H | F | $C_2H_5$ | $CH_3$ | $CH_3$ |
| I.a.1124 | Cl | H | F | H | F | $C_2H_5$ | $CH_3$ | $CH_3$ |
| I.a.1125 | CN | H | F | H | F | $C_2H_5$ | $CH_3$ | $CH_3$ |
| I.a.1126 | F | F | F | H | F | $C_2H_5$ | $CH_3$ | $CH_3$ |
| I.a.1127 | Cl | F | F | H | F | $C_2H_5$ | $CH_3$ | $CH_3$ |
| I.a.1128 | F | Cl | F | H | F | $C_2H_5$ | $CH_3$ | $CH_3$ |
| I.a.1129 | Cl | F | F | H | F | $C_2H_5$ | $CH_3$ | $CH_3$ |
| I.a.1130 | CN | F | F | H | F | $C_2H_5$ | $CH_3$ | $CH_3$ |
| I.a.1131 | F | CN | F | H | F | $C_2H_5$ | $CH_3$ | $CH_3$ |
| I.a.1132 | CN | F | F | H | F | $C_2H_5$ | $CH_3$ | $CH_3$ |
| I.a.1133 | F | F | H | F | F | $C_2H_5$ | $CH_3$ | $CH_3$ |
| I.a.1134 | Cl | F | H | F | F | $C_2H_5$ | $CH_3$ | $CH_3$ |
| I.a.1135 | F | Cl | H | F | F | $C_2H_5$ | $CH_3$ | $CH_3$ |
| I.a.1136 | CN | F | H | F | F | $C_2H_5$ | $CH_3$ | $CH_3$ |
| I.a.1137 | F | CN | H | F | F | $C_2H_5$ | $CH_3$ | $CH_3$ |
| I.a.1138 | F | F | F | F | F | $C_2H_5$ | $CH_3$ | $CH_3$ |
| I.a.1139 | Cl | F | F | F | F | $C_2H_5$ | $CH_3$ | $CH_3$ |
| I.a.1140 | F | Cl | F | F | F | $C_2H_5$ | $CH_3$ | $CH_3$ |
| I.a.1141 | CN | F | F | F | F | $C_2H_5$ | $CH_3$ | $CH_3$ |
| I.a.1142 | F | CN | F | F | F | $C_2H_5$ | $CH_3$ | $CH_3$ |
| I.a.1143 | H | F | F | F | F | $C_2H_5$ | $CH_3$ | $CH_3$ |
| I.a.1144 | F | F | Br | F | F | $C_2H_5$ | $CH_3$ | $CH_3$ |
| I.a.1145 | F | F | C≡CH | F | F | $C_2H_5$ | $CH_3$ | $CH_3$ |
| I.a.1146 | $CF_3$ | Cl | H | H | F | $C_2H_5$ | $CH_3$ | $CH_3$ |
| I.a.1147 | F | F | I | F | F | $C_2H_5$ | $CH_3$ | $CH_3$ |
| I.a.1148 | F | H | H | H | F | Cl | $CH_3$ | H |
| I.a.1149 | Cl | H | H | H | F | Cl | $CH_3$ | H |
| I.a.1150 | Br | H | H | H | F | Cl | $CH_3$ | H |
| I.a.1151 | CN | H | H | H | F | Cl | $CH_3$ | H |
| I.a.1152 | $CH_3$ | H | H | H | F | Cl | $CH_3$ | H |
| I.a.1153 | F | H | H | F | F | Cl | $CH_3$ | H |
| I.a.1154 | Cl | H | H | F | F | Cl | $CH_3$ | H |
| I.a.1155 | F | H | H | Cl | F | Cl | $CH_3$ | H |
| I.a.1156 | Cl | H | H | F | F | Cl | $CH_3$ | H |
| I.a.1157 | CN | H | H | F | F | Cl | $CH_3$ | H |
| I.a.1158 | F | H | H | CN | F | Cl | $CH_3$ | H |
| I.a.1159 | CN | H | H | F | F | Cl | $CH_3$ | H |
| I.a.1160 | F | H | F | H | F | Cl | $CH_3$ | H |
| I.a.1161 | Cl | H | F | H | F | Cl | $CH_3$ | H |
| I.a.1162 | CN | H | F | H | F | Cl | $CH_3$ | H |
| I.a.1163 | F | F | F | H | F | Cl | $CH_3$ | H |
| I.a.1164 | Cl | F | F | H | F | Cl | $CH_3$ | H |
| I.a.1165 | F | Cl | F | H | F | Cl | $CH_3$ | H |
| I.a.1166 | Cl | F | F | H | F | Cl | $CH_3$ | H |
| I.a.1167 | CN | F | F | H | F | Cl | $CH_3$ | H |
| I.a.1168 | F | CN | F | H | F | Cl | $CH_3$ | H |
| I.a.1169 | CN | F | F | H | F | Cl | $CH_3$ | H |
| I.a.1170 | F | F | H | F | F | Cl | $CH_3$ | H |
| I.a.1171 | Cl | F | H | F | F | Cl | $CH_3$ | H |
| I.a.1172 | F | Cl | H | F | F | Cl | $CH_3$ | H |
| I.a.1173 | CN | F | H | F | F | Cl | $CH_3$ | H |
| I.a.1174 | F | CN | H | F | F | Cl | $CH_3$ | H |
| I.a.1175 | F | F | F | F | F | Cl | $CH_3$ | H |
| I.a.1176 | Cl | F | F | F | F | Cl | $CH_3$ | H |
| I.a.1177 | F | Cl | F | F | F | Cl | $CH_3$ | H |
| I.a.1178 | CN | F | F | F | F | Cl | $CH_3$ | H |
| I.a.1179 | F | CN | F | F | F | Cl | $CH_3$ | H |
| I.a.1180 | H | F | F | F | F | Cl | $CH_3$ | H |
| I.a.1181 | F | F | Br | F | F | Cl | $CH_3$ | H |
| I.a.1182 | F | F | C≡CH | F | F | Cl | $CH_3$ | H |
| I.a.1183 | $CF_3$ | Cl | H | H | F | Cl | $CH_3$ | H |
| I.a.1184 | F | F | I | F | F | Cl | $CH_3$ | H |
| I.a.1185 | F | H | H | H | F | $CH_2Cl$ | Cl | $CH_3$ |
| I.a.1186 | Cl | H | H | H | F | $CH_2Cl$ | Cl | $CH_3$ |
| I.a.1187 | Br | H | H | H | F | $CH_2Cl$ | Cl | $CH_3$ |
| I.a.1188 | CN | H | H | H | F | $CH_2Cl$ | Cl | $CH_3$ |
| I.a.1189 | $CH_3$ | H | H | H | F | $CH_2Cl$ | Cl | $CH_3$ |
| I.a.1190 | F | H | H | F | F | $CH_2Cl$ | Cl | $CH_3$ |
| I.a.1191 | Cl | H | H | F | F | $CH_2Cl$ | Cl | $CH_3$ |
| I.a.1192 | F | H | H | Cl | F | $CH_2Cl$ | Cl | $CH_3$ |
| I.a.1193 | Cl | H | H | F | F | $CH_2Cl$ | Cl | $CH_3$ |
| I.a.1194 | CN | H | H | F | F | $CH_2Cl$ | Cl | $CH_3$ |
| I.a.1195 | F | H | H | CN | F | $CH_2Cl$ | Cl | $CH_3$ |
| I.a.1196 | CN | H | H | F | F | $CH_2Cl$ | Cl | $CH_3$ |
| I.a.1197 | F | H | F | H | F | $CH_2Cl$ | Cl | $CH_3$ |
| I.a.1198 | Cl | H | F | H | F | $CH_2Cl$ | Cl | $CH_3$ |
| I.a.1199 | CN | H | F | H | F | $CH_2Cl$ | Cl | $CH_3$ |
| I.a.1200 | F | F | F | H | F | $CH_2Cl$ | Cl | $CH_3$ |
| I.a.1201 | Cl | F | F | H | F | $CH_2Cl$ | Cl | $CH_3$ |
| I.a.1202 | F | Cl | F | H | F | $CH_2Cl$ | Cl | $CH_3$ |
| I.a.1203 | Cl | F | F | H | F | $CH_2Cl$ | Cl | $CH_3$ |
| I.a.1204 | CN | F | F | H | F | $CH_2Cl$ | Cl | $CH_3$ |

TABLE A-continued

| No. | $R^a$ | $R^b$ | $R^c$ | $R^d$ | $R^e$ | $R^2$ | $R^3$ | $R^4$ |
|---|---|---|---|---|---|---|---|---|
| I.a.1205 | F | CN | F | H | F | CH$_2$Cl | Cl | CH$_3$ |
| I.a.1206 | CN | F | F | H | F | CH$_2$Cl | Cl | CH$_3$ |
| I.a.1207 | F | F | H | F | F | CH$_2$Cl | Cl | CH$_3$ |
| I.a.1208 | Cl | F | H | F | F | CH$_2$Cl | Cl | CH$_3$ |
| I.a.1209 | F | Cl | H | F | F | CH$_2$Cl | Cl | CH$_3$ |
| I.a.1210 | CN | F | H | F | F | CH$_2$Cl | Cl | CH$_3$ |
| I.a.1211 | F | CN | H | F | F | CH$_2$Cl | Cl | CH$_3$ |
| I.a.1212 | F | F | F | F | F | CH$_2$Cl | Cl | CH$_3$ |
| I.a.1213 | Cl | F | F | F | F | CH$_2$Cl | Cl | CH$_3$ |
| I.a.1214 | F | Cl | F | F | F | CH$_2$Cl | Cl | CH$_3$ |
| I.a.1215 | CN | F | F | F | F | CH$_2$Cl | Cl | CH$_3$ |
| I.a.1216 | F | CN | F | F | F | CH$_2$Cl | Cl | CH$_3$ |
| I.a.1217 | H | F | F | F | F | CH$_2$Cl | Cl | CH$_3$ |
| I.a.1218 | F | F | Br | F | F | CH$_2$Cl | Cl | CH$_3$ |
| I.a.1219 | F | F | C≡CH | F | F | CH$_2$Cl | Cl | CH$_3$ |
| I.a.1220 | CF$_3$ | Cl | H | H | F | CH$_2$Cl | Cl | CH$_3$ |
| I.a.1221 | F | F | I | F | F | CH$_2$Cl | Cl | CH$_3$ |
| I.a.1222 | F | H | H | H | F | CN | CH$_3$ | CH$_3$ |
| I.a.1223 | Cl | H | H | H | F | CN | CH$_3$ | CH$_3$ |
| I.a.1224 | Br | H | H | H | F | CN | CH$_3$ | CH$_3$ |
| I.a.1225 | CN | H | H | H | F | CN | CH$_3$ | CH$_3$ |
| I.a.1226 | CH$_3$ | H | H | H | F | CN | CH$_3$ | CH$_3$ |
| I.a.1227 | F | H | H | F | F | CN | CH$_3$ | CH$_3$ |
| I.a.1228 | Cl | H | H | F | F | CN | CH$_3$ | CH$_3$ |
| I.a.1229 | F | H | H | Cl | F | CN | CH$_3$ | CH$_3$ |
| I.a.1230 | Cl | H | H | F | F | CN | CH$_3$ | CH$_3$ |
| I.a.1231 | CN | H | H | F | F | CN | CH$_3$ | CH$_3$ |
| I.a.1232 | F | H | H | CN | F | CN | CH$_3$ | CH$_3$ |
| I.a.1233 | CN | H | H | F | F | CN | CH$_3$ | CH$_3$ |
| I.a.1234 | F | H | F | H | F | CN | CH$_3$ | CH$_3$ |
| I.a.1235 | Cl | H | F | H | F | CN | CH$_3$ | CH$_3$ |
| I.a.1236 | CN | H | F | H | F | CN | CH$_3$ | CH$_3$ |
| I.a.1237 | F | F | F | H | F | CN | CH$_3$ | CH$_3$ |
| I.a.1238 | Cl | F | F | H | F | CN | CH$_3$ | CH$_3$ |
| I.a.1239 | F | Cl | F | H | F | CN | CH$_3$ | CH$_3$ |
| I.a.1240 | Cl | F | F | H | F | CN | CH$_3$ | CH$_3$ |
| I.a.1241 | CN | F | F | H | F | CN | CH$_3$ | CH$_3$ |
| I.a.1242 | F | CN | F | H | F | CN | CH$_3$ | CH$_3$ |
| I.a.1243 | CN | F | F | H | F | CN | CH$_3$ | CH$_3$ |
| I.a.1244 | F | F | H | F | F | CN | CH$_3$ | CH$_3$ |
| I.a.1245 | Cl | F | H | F | F | CN | CH$_3$ | CH$_3$ |
| I.a.1246 | F | Cl | H | F | F | CN | CH$_3$ | CH$_3$ |
| I.a.1247 | CN | F | H | F | F | CN | CH$_3$ | CH$_3$ |
| I.a.1248 | F | CN | H | F | F | CN | CH$_3$ | CH$_3$ |
| I.a.1249 | F | F | F | F | F | CN | CH$_3$ | CH$_3$ |
| I.a.1250 | Cl | F | F | F | F | CN | CH$_3$ | CH$_3$ |
| I.a.1251 | F | Cl | F | F | F | CN | CH$_3$ | CH$_3$ |
| I.a.1252 | CN | F | F | F | F | CN | CH$_3$ | CH$_3$ |
| I.a.1253 | F | CN | F | F | F | CN | CH$_3$ | CH$_3$ |
| I.a.1254 | H | F | F | F | F | CN | CH$_3$ | CH$_3$ |
| I.a.1255 | F | F | Br | F | F | CN | CH$_3$ | CH$_3$ |
| I.a.1256 | F | F | C≡CH | F | F | CN | CH$_3$ | CH$_3$ |
| I.a.1257 | CF$_3$ | Cl | H | H | F | CN | CH$_3$ | CH$_3$ |
| I.a.1258 | F | F | I | F | F | CN | CH$_3$ | CH$_3$ |
| I.a.1259 | F | H | H | H | F | OCH$_3$ | H | H |
| I.a.1260 | Cl | H | H | H | F | OCH$_3$ | H | H |
| I.a.1261 | Br | H | H | H | F | OCH$_3$ | H | H |
| I.a.1262 | CN | H | H | H | F | OCH$_3$ | H | H |
| I.a.1263 | CH$_3$ | H | H | H | F | OCH$_3$ | H | H |
| I.a.1264 | F | H | H | F | F | OCH$_3$ | H | H |
| I.a.1265 | Cl | H | H | F | F | OCH$_3$ | H | H |
| I.a.1266 | F | H | H | Cl | F | OCH$_3$ | H | H |
| I.a.1267 | Cl | H | H | F | F | OCH$_3$ | H | H |
| I.a.1268 | CN | H | H | F | F | OCH$_3$ | H | H |
| I.a.1269 | F | H | H | CN | F | OCH$_3$ | H | H |
| I.a.1270 | CN | H | H | F | F | OCH$_3$ | H | H |
| I.a.1271 | F | H | F | H | F | OCH$_3$ | H | H |
| I.a.1272 | Cl | H | F | H | F | OCH$_3$ | H | H |
| I.a.1273 | CN | H | F | H | F | OCH$_3$ | H | H |
| I.a.1274 | F | F | F | H | F | OCH$_3$ | H | H |
| I.a.1275 | Cl | F | F | H | F | OCH$_3$ | H | H |
| I.a.1276 | F | Cl | F | H | F | OCH$_3$ | H | H |
| I.a.1277 | Cl | F | F | H | F | OCH$_3$ | H | H |
| I.a.1278 | CN | F | F | H | F | OCH$_3$ | H | H |
| I.a.1279 | F | CN | F | H | F | OCH$_3$ | H | H |
| I.a.1280 | CN | F | F | H | F | OCH$_3$ | H | H |
| I.a.1281 | F | F | H | F | F | OCH$_3$ | H | H |
| I.a.1282 | Cl | F | H | F | F | OCH$_3$ | H | H |
| I.a.1283 | F | Cl | H | F | F | OCH$_3$ | H | H |
| I.a.1284 | CN | F | H | F | F | OCH$_3$ | H | H |
| I.a.1285 | F | CN | H | F | F | OCH$_3$ | H | H |
| I.a.1286 | F | F | F | F | F | OCH$_3$ | H | H |
| I.a.1287 | Cl | F | F | F | F | OCH$_3$ | H | H |
| I.a.1288 | F | Cl | F | F | F | OCH$_3$ | H | H |
| I.a.1289 | CN | F | F | F | F | OCH$_3$ | H | H |
| I.a.1290 | F | CN | F | F | F | OCH$_3$ | H | H |
| I.a.1291 | H | F | F | F | F | OCH$_3$ | H | H |
| I.a.1292 | F | F | Br | F | F | OCH$_3$ | H | H |
| I.a.1293 | F | F | C≡CH | F | F | OCH$_3$ | H | H |
| I.a.1294 | CF$_3$ | Cl | H | H | F | OCH$_3$ | H | H |
| I.a.1295 | F | F | I | F | F | OCH$_3$ | H | H |
| I.a.1296 | F | H | H | H | F | OCH$_3$ | CH$_3$ | H |
| I.a.1297 | Cl | H | H | H | F | OCH$_3$ | CH$_3$ | H |
| I.a.1298 | Br | H | H | H | F | OCH$_3$ | CH$_3$ | H |
| I.a.1299 | CN | H | H | H | F | OCH$_3$ | CH$_3$ | H |
| I.a.1300 | CH$_3$ | H | H | H | F | OCH$_3$ | CH$_3$ | H |
| I.a.1301 | F | H | H | F | F | OCH$_3$ | CH$_3$ | H |
| I.a.1302 | Cl | H | H | F | F | OCH$_3$ | CH$_3$ | H |
| I.a.1303 | F | H | H | Cl | F | OCH$_3$ | CH$_3$ | H |
| I.a.1304 | Cl | H | H | F | F | OCH$_3$ | CH$_3$ | H |
| I.a.1305 | CN | H | H | F | F | OCH$_3$ | CH$_3$ | H |
| I.a.1306 | F | H | H | CN | F | OCH$_3$ | CH$_3$ | H |
| I.a.1307 | CN | H | H | F | F | OCH$_3$ | CH$_3$ | H |
| I.a.1308 | F | H | F | H | F | OCH$_3$ | CH$_3$ | H |
| I.a.1309 | Cl | H | F | H | F | OCH$_3$ | CH$_3$ | H |
| I.a.1310 | CN | H | F | H | F | OCH$_3$ | CH$_3$ | H |
| I.a.1311 | F | F | F | H | F | OCH$_3$ | CH$_3$ | H |
| I.a.1312 | Cl | F | F | H | F | OCH$_3$ | CH$_3$ | H |
| I.a.1313 | F | Cl | F | H | F | OCH$_3$ | CH$_3$ | H |
| I.a.1314 | Cl | F | F | H | F | OCH$_3$ | CH$_3$ | H |
| I.a.1315 | CN | F | F | H | F | OCH$_3$ | CH$_3$ | H |
| I.a.1316 | F | CN | F | H | F | OCH$_3$ | CH$_3$ | H |
| I.a.1317 | CN | F | F | H | F | OCH$_3$ | CH$_3$ | H |
| I.a.1318 | F | F | H | F | F | OCH$_3$ | CH$_3$ | H |
| I.a.1319 | Cl | F | H | F | F | OCH$_3$ | CH$_3$ | H |
| I.a.1320 | F | Cl | H | F | F | OCH$_3$ | CH$_3$ | H |
| I.a.1321 | CN | F | H | F | F | OCH$_3$ | CH$_3$ | H |
| I.a.1322 | F | CN | H | F | F | OCH$_3$ | CH$_3$ | H |
| I.a.1323 | F | F | F | F | F | OCH$_3$ | CH$_3$ | H |
| I.a.1324 | Cl | F | F | F | F | OCH$_3$ | CH$_3$ | H |
| I.a.1325 | F | Cl | F | F | F | OCH$_3$ | CH$_3$ | H |
| I.a.1326 | CN | F | F | F | F | OCH$_3$ | CH$_3$ | H |
| I.a.1327 | F | CN | F | F | F | OCH$_3$ | CH$_3$ | H |
| I.a.1328 | H | F | F | F | F | OCH$_3$ | CH$_3$ | H |
| I.a.1329 | F | F | Br | F | F | OCH$_3$ | CH$_3$ | H |
| I.a.1330 | F | F | C≡CH | F | F | OCH$_3$ | CH$_3$ | H |
| I.a.1331 | CF$_3$ | Cl | H | H | F | OCH$_3$ | CH$_3$ | H |
| I.a.1332 | F | F | I | F | F | OCH$_3$ | CH$_3$ | H |
| I.a.1333 | F | H | H | H | F | OCH$_3$ | CH$_3$ | CH$_3$ |
| I.a.1334 | Cl | H | H | H | F | OCH$_3$ | CH$_3$ | CH$_3$ |
| I.a.1335 | Br | H | H | H | F | OCH$_3$ | CH$_3$ | CH$_3$ |
| I.a.1336 | CN | H | H | H | F | OCH$_3$ | CH$_3$ | CH$_3$ |
| I.a.1337 | CH$_3$ | H | H | H | F | OCH$_3$ | CH$_3$ | CH$_3$ |
| I.a.1338 | F | H | H | F | F | OCH$_3$ | CH$_3$ | CH$_3$ |
| I.a.1339 | Cl | H | H | F | F | OCH$_3$ | CH$_3$ | CH$_3$ |
| I.a.1340 | F | H | H | Cl | F | OCH$_3$ | CH$_3$ | CH$_3$ |
| I.a.1341 | Cl | H | H | F | F | OCH$_3$ | CH$_3$ | CH$_3$ |
| I.a.1342 | CN | H | H | F | F | OCH$_3$ | CH$_3$ | CH$_3$ |
| I.a.1343 | F | H | H | CN | F | OCH$_3$ | CH$_3$ | CH$_3$ |
| I.a.1344 | CN | H | H | F | F | OCH$_3$ | CH$_3$ | CH$_3$ |
| I.a.1345 | F | H | F | H | F | OCH$_3$ | CH$_3$ | CH$_3$ |
| I.a.1346 | Cl | H | F | H | F | OCH$_3$ | CH$_3$ | CH$_3$ |
| I.a.1347 | CN | H | F | H | F | OCH$_3$ | CH$_3$ | CH$_3$ |
| I.a.1348 | F | F | F | H | F | OCH$_3$ | CH$_3$ | CH$_3$ |
| I.a.1349 | Cl | F | F | H | F | OCH$_3$ | CH$_3$ | CH$_3$ |
| I.a.1350 | F | Cl | F | H | F | OCH$_3$ | CH$_3$ | CH$_3$ |
| I.a.1351 | Cl | F | F | H | F | OCH$_3$ | CH$_3$ | CH$_3$ |
| I.a.1352 | CN | F | F | H | F | OCH$_3$ | CH$_3$ | CH$_3$ |
| I.a.1353 | F | CN | F | H | F | OCH$_3$ | CH$_3$ | CH$_3$ |
| I.a.1354 | CN | F | F | H | F | OCH$_3$ | CH$_3$ | CH$_3$ |
| I.a.1355 | F | F | H | F | F | OCH$_3$ | CH$_3$ | CH$_3$ |
| I.a.1356 | Cl | F | H | F | F | OCH$_3$ | CH$_3$ | CH$_3$ |
| I.a.1357 | F | Cl | H | F | F | OCH$_3$ | CH$_3$ | CH$_3$ |
| I.a.1358 | CN | F | H | F | F | OCH$_3$ | CH$_3$ | CH$_3$ |
| I.a.1359 | F | CN | H | F | F | OCH$_3$ | CH$_3$ | CH$_3$ |
| I.a.1360 | F | F | F | F | F | OCH$_3$ | CH$_3$ | CH$_3$ |

TABLE A-continued

| No. | $R^a$ | $R^b$ | $R^c$ | $R^d$ | $R^e$ | $R^2$ | $R^3$ | $R^4$ |
|---|---|---|---|---|---|---|---|---|
| I.a.1361 | Cl | F | F | F | F | OCH$_3$ | CH$_3$ | CH$_3$ |
| I.a.1362 | F | Cl | F | F | F | OCH$_3$ | CH$_3$ | CH$_3$ |
| I.a.1363 | CN | F | F | F | F | OCH$_3$ | CH$_3$ | CH$_3$ |
| I.a.1364 | F | CN | F | F | F | OCH$_3$ | CH$_3$ | CH$_3$ |
| I.a.1365 | H | F | F | F | F | OCH$_3$ | CH$_3$ | CH$_3$ |
| I.a.1366 | F | F | Br | F | F | OCH$_3$ | CH$_3$ | CH$_3$ |
| I.a.1367 | F | F | C≡CH | F | F | OCH$_3$ | CH$_3$ | CH$_3$ |
| I.a.1368 | CF$_3$ | Cl | H | H | F | OCH$_3$ | CH$_3$ | CH$_3$ |
| I.a.1369 | F | F | I | F | F | OCH$_3$ | CH$_3$ | CH$_3$ |
| I.a.1370 | F | H | H | H | F | H | —O(CH$_2$)$_3$— | |
| I.a.1371 | Cl | H | H | H | F | H | —O(CH$_2$)$_3$— | |
| I.a.1372 | Br | H | H | H | F | H | —O(CH$_2$)$_3$— | |
| I.a.1373 | CN | H | H | H | F | H | —O(CH$_2$)$_3$— | |
| I.a.1374 | CH$_3$ | H | H | H | F | H | —O(CH$_2$)$_3$— | |
| I.a.1375 | F | H | H | F | F | H | —O(CH$_2$)$_3$— | |
| I.a.1376 | Cl | H | H | F | F | H | —O(CH$_2$)$_3$— | |
| I.a.1377 | F | H | H | Cl | F | H | —O(CH$_2$)$_3$— | |
| I.a.1378 | Cl | H | H | F | F | H | —O(CH$_2$)$_3$— | |
| I.a.1379 | CN | H | H | F | F | H | —O(CH$_2$)$_3$— | |
| I.a.1380 | F | H | H | CN | F | H | —O(CH$_2$)$_3$— | |
| I.a.1381 | CN | H | H | F | F | H | —O(CH$_2$)$_3$— | |
| I.a.1382 | F | H | F | H | F | H | —O(CH$_2$)$_3$— | |
| I.a.1383 | Cl | H | F | H | F | H | —O(CH$_2$)$_3$— | |
| I.a.1384 | CN | H | F | H | F | H | —O(CH$_2$)$_3$— | |
| I.a.1385 | F | F | F | H | F | H | —O(CH$_2$)$_3$— | |
| I.a.1386 | Cl | F | F | H | F | H | —O(CH$_2$)$_3$— | |
| I.a.1387 | F | Cl | F | H | F | H | —O(CH$_2$)$_3$— | |
| I.a.1388 | Cl | F | F | H | F | H | —O(CH$_2$)$_3$— | |
| I.a.1389 | CN | F | F | H | F | H | —O(CH$_2$)$_3$— | |
| I.a.1390 | F | CN | F | H | F | H | —O(CH$_2$)$_3$— | |
| I.a.1391 | CN | F | F | H | F | H | —O(CH$_2$)$_3$— | |
| I.a.1392 | F | F | H | F | F | H | —O(CH$_2$)$_3$— | |
| I.a.1393 | Cl | F | H | F | F | H | —O(CH$_2$)$_3$— | |
| I.a.1394 | F | Cl | H | F | F | H | —O(CH$_2$)$_3$— | |
| I.a.1395 | CN | F | H | F | F | H | —O(CH$_2$)$_3$— | |
| I.a.1396 | F | CN | H | F | F | H | —O(CH$_2$)$_3$— | |
| I.a.1397 | F | F | F | F | F | H | —O(CH$_2$)$_3$— | |
| I.a.1398 | Cl | F | F | F | F | H | —O(CH$_2$)$_3$— | |
| I.a.1399 | F | Cl | F | F | F | H | —O(CH$_2$)$_3$— | |
| I.a.1400 | CN | F | F | F | F | H | —O(CH$_2$)$_3$— | |
| I.a.1401 | F | CN | F | F | F | H | —O(CH$_2$)$_3$— | |
| I.a.1402 | H | F | F | F | F | H | —O(CH$_2$)$_3$— | |
| I.a.1403 | F | F | Br | F | F | H | —O(CH$_2$)$_3$— | |
| I.a.1404 | F | F | C≡CH | F | F | H | —O(CH$_2$)$_3$— | |
| I.a.1405 | CF3 | Cl | H | H | F | H | —O(CH$_2$)$_3$— | |
| I.a.1406 | F | F | I | F | F | H | —O(CH$_2$)$_3$— | |

In another preferred embodiment, the azines useful for the present invention are azines of formula (I)

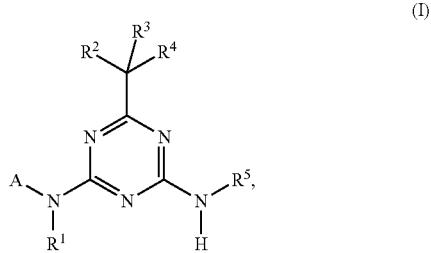

(I)

wherein
A is heteroaryl, which is substituted by 1, 2, 3, 4, 5 or 6 substituents $R^A$ selected from the group consisting of halogen, OH, CN, amino, NO$_2$, C$_1$-C$_6$-alkyl, C$_2$-C$_6$-alkenyl, C$_2$-C$_6$-alkynyl, C$_1$-C$_6$-alkoxy, C$_2$-C$_6$-alkenyloxy, C$_2$-C$_6$-alkynyloxy, (C$_1$-C$_6$-alkoxy)-C$_1$-C$_6$-alkyl, (C$_1$-C$_6$-alkoxy)-C$_1$-C$_6$-alkoxy, (C$_1$-C$_6$-alkoxy)-C$_2$-C$_6$-alkenyl, (C$_1$-C$_6$-alkoxy)-C$_2$-C$_6$-alkynyl, C$_1$-C$_6$-alkylthio, (C$_1$-C$_6$-alkyl)sulfinyl, (C$_1$-C$_6$-alkyl)sulfonyl, (C$_1$-C$_6$-alkyl)amino, di(C$_1$-C$_6$-alkyl)amino, (C$_1$-C$_6$-alkyl)-carbonyl, (C$_1$-C$_6$-alkoxy)-carbonyl, (C$_1$-C$_6$-alkyl)-carbonyloxy, C$_3$-C$_6$-cycloalkyl, C$_3$-C$_6$-cycloalkoxy, (C$_3$-C$_6$-cycloalkyl)-C$_1$-C$_4$-alkyl, (C$_3$-C$_6$-cycloalkyl)-C$_1$-C$_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups;

$R^1$ is selected from the group consisting of H, OH, S(O)$_2$NH$_2$, CN, C$_1$-C$_6$-alkyl, C$_2$-C$_6$-alkenyl, C$_2$-C$_6$-alkynyl, (C$_3$-C$_6$-cycloalkyl)-C$_1$-C$_4$-alkyl, C$_1$-C$_6$-alkoxy, (C$_1$-C$_6$-alkoxy)-C$_1$-C$_6$-alkyl, (C$_1$-C$_6$-alkyl)-carbonyl, (C$_1$-C$_6$-alkoxy)carbonyl, (C$_1$-C$_6$-alkyl)sulfonyl, (C$_1$-C$_6$-alkylamino)carbonyl, di(C$_1$-C$_6$-alkyl)aminocarbonyl, (C$_1$-C$_6$-alkylamino)sulfonyl, di(C$_1$-C$_6$-alkyl)aminosulfonyl and (C$_1$-C$_6$-alkoxy)sulfonyl, where the aliphatic and cycloaliphatic parts of the 14 aforementioned radicals are unsubstituted, partly or completely halogenated, phenyl, phenyl-C$_1$-C$_6$-alkyl, phenylsulfonyl, phenylaminosulfonyl, phenylcarbonyl and phenoxycarbonyl, wherein phenyl in the last 6 mentioned radicals are unsubstituted or substituted by 1, 2, 3, 4 or 5 identical or different substituents selected from the group consisting of halogen, CN, NO$_2$, C$_1$-C$_6$-alkyl, C$_1$-C$_6$-haloalkyl, C$_1$-C$_6$-alkoxy and C$_1$-C$_6$-haloalkoxy;

$R^2$ is H, halogen, OH, CN, C$_1$-C$_6$-alkyl, C$_2$-C$_6$-alkenyl, C$_3$-C$_6$-alkynyl, (C$_1$-C$_6$-alkoxy)-C$_1$-C$_6$-alkyl, C$_3$-C$_6$-cycloalkyl, C$_3$-C$_6$-cycloalkenyl, (C$_3$-C$_6$-cycloalkyl)-C$_1$-C$_4$-alkyl, C$_1$-C$_6$-alkoxy, C$_2$-C$_6$-alkenyloxy, C$_2$-C$_6$-alkynyloxy, C$_3$-C$_6$-cycloalkoxy or (C$_3$-C$_6$-cycloalkyl)-C$_1$-C$_4$-alkoxy, where the aliphatic and cycloaliphatic parts of the 9 aforementioned radicals are unsubstituted, partly or completely halogenated, phenyl, phenyl-C$_1$-C$_6$-alkyl, wherein phenyl in the last 2 mentioned radicals are unsubstituted or substituted by 1, 2, 3, 4 or 5 identical or different substituents selected from the group consisting of halogen, CN, NO$_2$, C$_1$-C$_6$-alkyl, C$_1$-C$_6$-haloalkyl, C$_1$-C$_6$-alkoxy and C$_1$-C$_6$-haloalkoxy;

$R^3$ is selected from the group consisting of H, halogen, CN, C$_1$-C$_6$-alkyl, C$_1$-C$_6$-haloalkyl, C$_1$-C$_6$-alkoxy and C$_1$-C$_6$-haloalkoxy;

$R^4$ is selected from the group consisting of H, halogen, CN, C$_1$-C$_6$-alkyl, C$_2$-C$_6$-alkenyl, C$_3$-C$_6$-alkynyl, C$_3$-C$_6$-cycloalkyl, (C$_3$-C$_6$-cycloalkyl)-C$_1$-C$_4$-alkyl, C$_3$-C$_6$-cycloalkenyl and C$_1$-C$_6$-alkoxy-C$_1$-C$_6$-alkyl, where the aliphatic and cycloaliphatic parts of the 7 aforementioned radicals are unsubstituted, partly or completely halogenated: or $R^3$ and $R^4$ together with the carbon atom to which they are attached form a moiety selected from the group consisting of carbonyl, C$_2$-C$_6$-alkenyl, C$_3$-C$_6$-cycloalkyl, C$_3$-C$_6$-cycloalkenyl and three- to six-membered heterocyclyl, wherein the C$_3$-C$_6$-cycloalkyl, C$_3$-C$_6$-cycloalkenyl, or three- to six-membered heterocyclyl is unsubstituted or substituted by one to three substituents selected from halogen, CN, C$_1$-C$_6$-alkyl and C$_1$-C$_6$-alkoxy; and $R^5$ is selected from the group consisting of H, OH, S(O)$_2$NH$_2$, CN, C$_1$-C$_6$-alkyl, C$_2$-C$_6$-alkenyl, C$_2$-C$_6$-alkynyl, (C$_3$-C$_6$-cycloalkyl)-C$_1$-C$_4$-alkyl, C$_1$-C$_6$-alkoxy, (C$_1$-C$_6$-alkoxy)-C$_1$-C$_6$-alkyl, (C$_1$-C$_6$-alkyl)-carbonyl, (C$_1$-C$_6$-alkoxy)carbonyl, (C$_1$-C$_6$-alkyl)sulfonyl, (C$_1$-C$_6$-alkylamino)carbonyl, di(C$_1$-C$_6$-alkyl)aminocarbonyl, (C$_1$-C$_6$-alkylamino)sulfonyl, di(C$_1$-C$_6$-alkyl)aminosulfonyl and (C$_1$-C$_6$-alkoxy)sulfonyl, where the aliphatic and cycloaliphatic parts of the 14 aforementioned radicals are unsubstituted, partly or completely halogenated, phenyl, phenyl-$C_1$-$C_6$-alkyl, phenylsulfonyl, phenylaminosulfonyl, phenylcarbonyl and phenoxycarbonyl, wherein phenyl in the last 6 mentioned radicals are unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

and wherein the variables A, $R^1$, $R^2$, $R^3$, $R^4$ and $R^5$ are in particular:

A is heteroaryl, which is substituted by 1, 2, 3, 4, 5 or 6 substituents $R^A$ selected from the group consisting of halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl, ($C_1$-$C_6$-alkoxy)-$C_1$-$C_6$-alkoxy, ($C_1$-$C_6$-alkoxy)-$C_2$-$C_6$-alkenyl, ($C_1$-$C_6$-alkoxy)-$C_2$-$C_6$-alkynyl, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, ($C_1$-$C_6$-alkyl)-carbonyloxy, $C_3$-$C_6$-cycloalkyl, $C_3$-$C_6$-cycloalkoxy, ($C_3$-$C_6$-cycloalkyl)-$C_1$-$C_4$-alkyl, ($C_3$-$C_6$-cycloalkyl)-$C_1$-$C_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups;

$R^1$ is selected from the group consisting of H, OH, $S(O)_2NH_2$, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 14 aforementioned radicals are unsubstituted, partly or completely halogenated, phenyl, phenyl-$C_1$-$C_6$-alkyl, phenylsulfonyl, phenylaminosulfonyl, phenylcarbonyl and phenoxycarbonyl, wherein phenyl in the last 6 mentioned radicals are unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

$R^2$ is H, halogen, OH, CN, $C_1$-$C_6$-alkyl, $C_2$-$C_6$-alkenyl, $C_3$-$C_6$-alkynyl, ($C_1$-$C_6$-alkoxy)-$C_1$-$C_6$-alkyl, $C_3$-$C_6$-cycloalkyl, $C_3$-$C_6$-cycloalkenyl, ($C_3$-$C_6$-cycloalkyl)-$C_1$-$C_4$-alkyl, $C_1$-$C_6$-alkoxy, $C_2$-$C_6$-alkenyloxy, $C_2$-$C_6$-alkynyloxy, $C_3$-$C_6$-cycloalkoxy or ($C_3$-$C_6$-cycloalkyl)-$C_1$-$C_4$-alkoxy, where the aliphatic and cycloaliphatic parts of the 9 aforementioned radicals are unsubstituted, partly or completely halogenated or phenyl, wherein phenyl is unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

$R^3$ is selected from the group consisting of H, halogen, CN, $C_1$-$C_6$-alkyl, $C_1$-$C_6$-haloalkyl, $C_1$-$C_6$-alkoxy and $C_1$-$C_6$-haloalkoxy;

$R^4$ is selected from the group consisting of H, halogen, CN, $C_1$-$C_6$-alkyl, $C_2$-$C_6$-alkenyl, $C_3$-$C_6$-alkynyl, $C_3$-$C_6$-cycloalkyl, ($C_3$-$C_6$-cycloalkyl)-$C_1$-$C_4$-alkyl, $C_3$-$C_6$-cycloalkenyl and $C_1$-$C_6$-alkoxy-$C_1$-$C_6$-alkyl, where the aliphatic and cycloaliphatic parts of the 7 aforementioned radicals are unsubstituted, partly or completely halogenated; or $R^3$ and $R^4$ together with the carbon atom to which they are attached form a moiety selected from the group consisting of carbonyl, $C_2$-$C_6$-alkenyl, $C_3$-$C_6$-cycloalkyl, $C_3$-$C_6$-cycloalkenyl and three- to six-membered heterocyclyl, wherein the $C_3$-$C_6$-cycloalkyl, $C_3$-$C_6$-cycloalkenyl, or three- to six-membered heterocyclyl is unsubstituted or substituted by one to three substituents selected from halogen, CN, $C_1$-$C_6$-alkyl and $C_1$-$C_6$-alkoxy; and $R^5$ is selected from the group consisting of H, OH, $S(O)_2NH_2$, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 14 aforementioned radicals are unsubstituted, partly or completely halogenated, phenyl, phenyl-$C_1$-$C_6$-alkyl, phenylsulfonyl, phenylaminosulfonyl, phenylcarbonyl and phenoxycarbonyl, wherein phenyl in the last 6 mentioned radicals are unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

and wherein the variables A, $R^1$, $R^2$, $R^3$, $R^4$ and $R^5$ are in more particular:

A is heteroaryl, which is substituted by 1, 2, 3, 4, 5 or 6 substituents $R^A$ selected from the group consisting of halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl, ($C_1$-$C_6$-alkoxy)-$C_1$-$C_6$-alkoxy, ($C_1$-$C_6$-alkoxy)-$C_2$-$C_6$-alkenyl, ($C_1$-$C_6$-alkoxy)-$C_2$-$C_6$-alkynyl, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, ($C_1$-$C_6$-alkyl)-carbonyloxy, $C_3$-$C_6$-cycloalkyl, $C_3$-$C_6$-cycloalkoxy, ($C_3$-$C_6$-cycloalkyl)-$C_1$-$C_4$-alkyl, ($C_3$-$C_6$-cycloalkyl)-$C_1$-$C_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups;

$R^1$ is selected from the group consisting of H, OH, $S(O)_2NH_2$, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 14 aforementioned radicals are unsubstituted, partly or completely halogenated, phenyl, phenyl-$C_1$-$C_6$-alkyl, phenylsulfonyl, phenylaminosulfonyl, phenylcarbonyl and phenoxycarbonyl, wherein phenyl in the last 6 mentioned radicals are unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

$R^2$ is H, halogen, OH, CN, $C_1$-$C_6$-alkyl, $C_2$-$C_6$-alkenyl, $C_3$-$C_6$-alkynyl, ($C_1$-$C_6$-alkoxy)-$C_1$-$C_6$-alkyl, $C_3$-$C_6$-cycloalkyl, $C_3$-$C_6$-cycloalkenyl, ($C_3$-$C_6$-cycloalkyl)-$C_1$-$C_4$-alkyl, $C_1$-$C_6$-alkoxy, $C_2$-$C_6$-alkenyloxy, $C_2$-$C_6$-alkynyloxy, $C_3$-$C_6$-cycloalkoxy or ($C_3$-$C_6$-cycloalkyl)-$C_1$-$C_4$-alkoxy, where the aliphatic and cycloaliphatic parts of the 9 aforementioned radicals are unsubstituted, partly or completely halogenated, $R^3$ is selected from the group consisting of H, halogen, CN, $C_1$-$C_6$-alkyl, $C_1$-$C_6$-haloalkyl, $C_1$-$C_6$-alkoxy and $C_1$-$C_6$-haloalkoxy;

$R^4$ is selected from the group consisting of H, halogen, CN, $C_1$-$C_6$-alkyl, $C_2$-$C_6$-alkenyl, $C_3$-$C_6$-alkynyl, $C_3$-$C_6$-cycloalkyl, ($C_3$-$C_6$-cycloalkyl)-$C_1$-$C_4$-alkyl, $C_3$-$C_6$-cycloalkenyl and $C_1$-$C_6$-alkoxy-$C_1$-$C_6$-alkyl, where the aliphatic and cycloaliphatic parts of the 7 aforementioned radicals are unsubstituted, partly or completely halogenated; or $R^3$ and $R^4$ together with the carbon atom to which they are attached form a moiety selected from the group consisting of carbonyl, $C_2$-$C_6$-alkenyl, $C_3$-$C_6$-cycloalkyl, $C_3$-$C_6$-cycloalkenyl and three- to six-membered heterocyclyl, wherein the $C_3$-$C_6$-cycloalkyl, $C_3$-$C_6$-cycloalkenyl, or three- to six-membered heterocyclyl is unsubstituted or substituted by one to three substituents selected from halogen, CN, $C_1$-$C_6$-alkyl and $C_1$-$C_6$-alkoxy; and $R^5$ is selected from the group consisting of H, OH, $S(O)_2NH_2$, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 14 aforementioned radicals are unsubstituted, partly or completely halogenated, phenyl, phenyl-$C_1$-$C_6$-alkyl, phenylsulfonyl, phenylaminosulfonyl, phenylcarbonyl and phenoxycarbonyl, wherein phenyl in the last 6 mentioned radicals are unsubstituted or substituted by 1, 2, 3, 4 or 5 identical or different substituents selected from the group consisting of halogen, CN, NO, $C_1$-$C_6$-alkyl. $C_1$-$C_6$-haloalkyl. $C_1$-$C_6$-alkoxy and $C_1$-$C_6$-haloalkoxy;

and wherein the variables A, $R^1$, $R^2$, $R^3$, $R^4$ and $R^5$ are preferred:

A is heteroaryl, which is substituted by one to six substituents selected from the group consisting of halogen, CN, $NO_2$, $C_1$-$C_6$-alkyl, $C_1$-$C_6$-haloalkyl, OH, $C_1$-$C_6$-alkoxy, $C_1$-$C_6$-alkylthio, ($C_1$-$C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)carbonyl, ($C_1$-$C_6$-alkoxy)carbonyl;

$R^1$ is H, CN, $C_1$-$C_6$-alkyl, $C_1$-$C_6$-alkoxy-$C_1$-$C_6$-alkyl, $C_1$-$C_6$-alkoxy, ($C_1$-$C_6$-alkyl)carbonyl, ($C_1$-$C_6$-alkoxy)carbonyl, ($C_1$-$C_6$-alkyl)sulfonyl or phenylsulfonyl, wherein the phenyl is unsubstituted or substituted by one to five substituents selected from the group consisting of halogen, CN, $NO_2$, $C_1$-$C_6$-alkyl, $C_1$-$C_6$-haloalkyl and $C_1$-$C_6$-alkoxy;

$R^2$ is H, halogen, OH, CN, $C_1$-$C_6$-alkyl, $C_2$-$C_6$-alkenyl, $C_3$-$C_6$-alkynyl, ($C_1$-$C_6$-alkoxy)-$C_1$-$C_6$-alkyl, $C_3$-$C_6$-cycloalkyl, $C_3$-$C_6$-cycloalkenyl, ($C_3$-$C_6$-cycloalkyl)-$C_1$-$C_4$-alkyl, $C_1$-$C_6$-alkoxy, $C_2$-$C_6$-alkenyloxy, $C_2$-$C_6$-alkynyloxy, $C_3$-$C_6$-cycloalkoxy or ($C_3$-$C_6$-cycloalkyl)-$C_1$-$C_4$-alkoxy, where the aliphatic and cycloaliphatic parts of the 9 aforementioned radicals are unsubstituted, partly or completely halogenated $R^3$ is H, halogen, CN, $C_1$-$C_6$-alkyl, $C_1$-$C_6$-haloalkyl or $C_1$-$C_6$-alkoxy;

$R^4$ is H, halogen, CN, $C_1$-$C_6$-alkyl or $C_1$-$C_6$-haloalkyl; or $R^3$ and $R^4$ together with the carbon atom to which they are attached form a moiety selected from the group consisting of carbonyl, $C_2$-$C_6$-alkenyl, $C_3$-$C_6$-cycloalkyl, $C_3$-$C_6$-cycloalkenyl and three- to six-membered heterocyclyl, wherein the $C_3$-$C_6$-cycloalkyl, $C_3$-$C_6$-cycloalkenyl, or three- to six-membered heterocyclyl is unsubstituted or substituted by one to three substituents selected from halogen, CN, $C_1$-$C_6$-alkyl and $C_1$-$C_6$-alkoxy; and $R^5$ is H, CN, $C_1$-$C_6$-alkyl, $C_1$-$C_6$-alkoxy-$C_1$-$C_6$-alkyl, $C_1$-$C_6$-alkoxy, ($C_1$-$C_6$-alkyl)carbonyl, ($C_1$-$C_6$-alkoxy)carbonyl, ($C_1$-$C_6$-alkyl)sulfonyl or phenylsulfonyl, wherein the phenyl is unsubstituted or substituted by one to five substituents selected from the group consisting of halogen, CN, $NO_2$, $C_1$-$C_6$-alkyl, $C_1$-$C_6$-haloalkyl and $C_1$-$C_6$-alkoxy;

including their agriculturally acceptable salts or N-oxides.

In another preferred embodiment, the azines useful for the present invention comprise a diaminotriazine compound of formula (I)

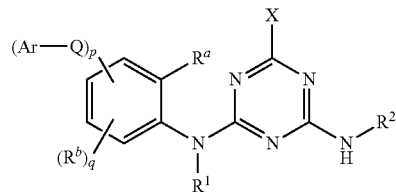

wherein p is 1 or 2;

q is 0, 1, 2 or 3 provided that p+q is 1, 2, 3 or 4;

Q is a chemical bond, O, $S(O)_m$, $CR^{q1}R^{g2}$, $NR^{q3}$, $C(O)$, $C(O)O$, $CR^{q1}R^{g2}$—O, $S(O)_mNR^{g3}$ or $C(O)NR^{g3}$, wherein m is 0, 1 or 2;

$R^{q1}$, $R^{q2}$ are hydrogen, halogen or $C_1$-$C_4$-alkyl;

$R^{q3}$ is H, CN, $C_1$-$C_6$-alkyl, ($C_1$-$C_6$-alkoxy)-$C_1$-$C_6$-alkyl, ($C_1$-$C_6$-alkyl)-carbonyl, ($C_1$-$C_6$-alkoxy)carbonyl, ($C_1$-$C_6$-alkyl)sulfonyl, where the aliphatic parts of the 6 aforementioned radicals are unsubstituted, partly or completely halogenated;

Ar is phenyl, which is unsubstituted or carries 1, 2, 3, 4 or 5 radicals $R^A$ which are selected from the group consisting of halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl, ($C_1$-$C_6$-alkoxy)-$C_1$-$C_6$-alkoxy, ($C_1$-$C_6$-alkoxy)-$C_2$-$C_6$-alkenyl, ($C_1$-$C_6$-alkoxy)-$C_2$-$C_6$-alkynyl, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)carbonyl, ($C_1$-$C_6$-alkyl)-carbonyloxy, $C_3$-$C_6$-cycloalkyl, $C_3$-$C_6$-cycloalkoxy, ($C_3$-$C_6$-cycloalkyl)-$C_1$-$C_4$-alkyl, ($C_3$-$C_6$-cycloalkyl)-$C_1$-$C_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups, phenyl, phenyl-$C_1$-$C_6$-alkyl, phenylsulfonyl, phenylaminosulfonyl, phenylaminocarbonyl, phenyl ($C_1$-$C_6$-alkyl)aminocarbonyl, phenylcarbonyl and phenoxycarbonyl, wherein phenyl in the last 8 mentioned radicals are unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy, it being possible that $R^A$ are identical or different;

$R^a$ is selected from the group consisting of hydrogen, halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, ($C_1$-$C_6$-alkyl)-carbonyloxy, where the aliphatic and cycloaliphatic parts of the 14 aforementioned radicals are unsubstituted, partly or completely halogenated;

$R^b$ is selected from the group consisting of halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl, ($C_1$-$C_6$-alkoxy)-$C_1$-$C_6$-alkoxy, ($C_1$-$C_6$-alkoxy)-$C_2$-$C_6$-alkenyl, ($C_1$-$C_6$-alkoxy)-$C_2$-$C_6$-alkynyl, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, ($C_1$-$C_6$-alkyl)-carbonyloxy, $C_3$-$C_6$-cycloalkyl, $C_3$-$C_6$-cycloalkoxy, ($C_3$-$C_6$-cycloalkyl)-$C_1$-$C_4$-alkyl, ($C_3$-$C_6$-cycloalkyl)-$C_1$-$C_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups, for q=2 or 3 it being possible that $R^b$ are identical or different;

$R^1$ is selected from the group consisting of H, OH, $S(O)_2NH_2$, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_3$-$C_6$-cycloalkyl)-carbonyl, ($C_1$-$C_6$-alkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 15 aforementioned radicals are unsubstituted, partly or completely halogenated, phenyl, phenyl-$C_1$-$C_6$-alkyl, phenylsulfonyl, phenylaminosulfonyl, phenylaminocarbonyl, phenyl($C_1$-$C_6$-alkyl)aminocarbonyl, phenylcarbonyl and phenoxycarbonyl, wherein phenyl in the last 8 mentioned radicals are unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

$R^2$ is selected from the group consisting of H, OH, $S(O)_2NH_2$, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_3$-$C_6$-cycloalkyl)-carbonyl $C_1$-$C_6$-alkoxy, ($C_1$-$C_6$-alkoxy)-$C_1$-$C_6$-alkyl, ($C_1$-$C_6$-alkyl)carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 15 aforementioned radicals are unsubstituted, partly or completely halogenated, phenyl, phenylsulfonyl, phenylaminosulfonyl, phenylaminocarbonyl, phenyl($C_1$-$C_6$-alkyl)aminocarbonyl, phenyl-$C_1$-$C_6$ alkyl, phenoxy, phenylcarbonyl and phenoxycarbonyl, wherein phenyl in the last 9 mentioned radicals is unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

X is a radical selected from the group consisting of
$CR^3R^4R^5$,
phenyl, which is unsubstituted or carries 1, 2, 3, 4 or 5 radicals $R^{Ar}$ which are identical or different;
$NR^{3a}R^{3b}$,
$OR^{3c}$ and
$S(O)_kR^{3d}$ with k being 0, 1 or 2 wherein $R^3$ is selected from the group consisting of H, halogen, OH, CN, $C_1$-$C_6$-alkyl, ($C_1$-$C_6$-alkoxy)-$C_1$-$C_6$-alkyl, $C_3$-$C_6$-cycloalkyl, ($C_3$-$C_6$-cycloalkyl)-$C_1$-$C_4$-alkyl, $C_1$-$C_6$-alkoxy, $C_2$-$C_6$-alkenyloxy, $C_2$-$C_6$-alkynyloxy, $C_3$-$C_6$-cycloalkoxy, ($C_3$-$C_6$-cycloalkyl)-$C_1$-$C_4$-alkoxy, where the aliphatic and cycloaliphatic parts of the 9 aforementioned radicals are unsubstituted, partly or completely halogenated;

$R^4$ is selected from the group consisting of H, halogen, CN, $C_1$-$C_6$-alkyl, $C_1$-$C_6$-haloalkyl, $C_1$-$C_6$-alkoxy and $C_1$-$C_6$-haloalkoxy;

$R^5$ is selected from the group consisting of halogen, CN, $C_1$-$C_6$-alkyl, $C_2$-$C_6$-alkenyl, $C_3$-$C_6$-alkynyl, $C_3$-$C_6$-cycloalkyl, ($C_3$-$C_6$-cycloalkyl)-$C_1$-$C_4$-alkyl, $C_3$-$C_6$-cycloalkenyl and $C_1$-$C_6$-alkoxy-$C_1$-$C_6$-alkyl, where the aliphatic and cycloaliphatic parts of the 7 aforementioned radicals are unsubstituted, partly or completely halogenated;

$R^4$ and $R^5$ together with the carbon atom to which they are attached form a moiety selected from the group consisting of carbonyl, $C_3$-$C_6$-cycloalkyl, $C_3$-$C_6$-cycloalkenyl, three- to six-membered saturated or partially unsaturated heterocyclyl, and the moiety >C=$CR^xR^y$, where $R^x$ and $R^y$ are hydrogen, $C_1$-$C_4$-alkyl or $C_1$-$C_4$-haloalkyl;

$R_{Ar}$ selected from the group consisting of halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl, ($C_1$-$C_6$-alkoxy)-$C_1$-$C_6$-alkoxy, ($C_1$-$C_6$-alkoxy)-$C_2$-$C_6$-alkenyl, ($C_1$-$C_6$-alkoxy)-$C_2$-$C_6$-alkynyl, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, ($C_1$-$C_6$-alkyl)-carbonyloxy, $C_3$-$C_6$-cycloalkyl, $C_3$-$C_6$-cycloalkoxy, ($C_3$-$C_6$-cycloalkyl)-$C_1$-$C_4$-alkyl, ($C_3$-$C_6$-cycloalkyl)-$C_1$-$C_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups, $R^{3a}$, $R^{3b}$, $R^{3c}$ or $R^{3d}$ are independently of one another are selected from the group consisting of H, CN, $S(O)_2NH_2$, $C_1$-$C_6$-alkyl, $C_2$-$C_6$-alkenyl, $C_2$-$C_6$-alkynyl, $C_3$-$C_6$-cycloalkyl, ($C_3$-$C_6$-cycloalkyl)-$C_1$-$C_6$-alkyl, ($C_1$-$C_6$-alkoxy)-$C_1$-$C_6$-alkyl, ($C_1$-$C_6$-alkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_3$-$C_6$-cycloalkyl)-carbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 15 aforementioned radicals are unsubstituted, partly or completely halogenated, phenyl, phenylsulfonyl, phenyl-$C_1$-$C_6$ alkyl, phenylaminosulfonyl, phenylcarbonyl and phenoxycarbonyl, wherein phenyl in the last 6 mentioned radicals is unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy, or $R^{3a}$, $R^{3b}$ together with the nitrogen atom, to which they are bound, form an N-bound, mono- or bicyclic heterocyclic radical, which may have 1, 2, 3 or 4 further heteroatoms which are selected from N, O and S, which is unsubstituted or substituted by one or more identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy, one of $R^3$, $R^{3b}$ may also be OH, $C_1$-$C_6$-alkoxy, $C_3$-$C_6$-cycloalkoxy, ($C_3$-$C_6$-cycloalkyl)-$C_1$-$C_4$-alkoxy $C_2$-$C_6$-alkenyloxy, $C_2$-$C_6$-alkynyloxy, ($C_1$-$C_6$-alkoxy)-$C_1$-$C_6$-alkoxy, where the aliphatic and cycloaliphatic parts of the 7 aforementioned radicals are unsubstituted, partly or completely halogenated, or phenoxy, which is unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

including their agriculturally acceptable salts

In another preferred embodiment, the azines useful for the present invention comprises a diaminotriazine compound of the formula:

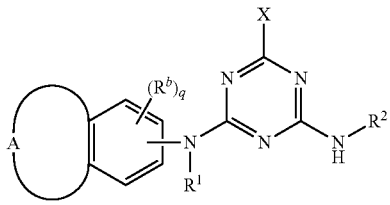

wherein

A is a fused saturated or unsaturated, 5- or 6-membered carbocycle or a fused saturated or unsaturated, 5- or 6-membered heterocycle having 1, 2 or 3 heteroatoms or heteroatom moieties, selected from O, S, $S(O)_p$, N or $NR^c$ as ring members, where the carbocycle and the heterocycle are unsubstituted or carry 1, 2, 3 or 4 radicals $R^A$;

p is 0, 1 or 2 q is 0, 1, 2 or 3;

$R^A$ is selected from the group consisting of halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl, ($C_1$-$C_6$-alkoxy)-$C_1$-$C_6$-alkoxy, ($C_1$-$C_6$-alkoxy)-$C_2$-$C_6$-alkenyl, ($C_1$-$C_6$-alkoxy)-$C_2$-$C_6$-alkynyl, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, ($C_1$-$C_6$-alkyl)-carbonyloxy, $C_3$-$C_6$-cycloalkyl, $C_3$-$C_6$-cycloalkoxy, ($C_3$-$C_6$-cycloalkyl)-$C_1$-$C_4$-alkyl, ($C_3$-$C_6$-cycloalkyl)-$C_1$-$C_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups, it being possible that $R^A$ are identical or different, it being possible that two radicals $R^A$ which are bound at the same carbon atom may together be =O or =$NR^d$;

$R^b$ is selected from the group consisting of halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl, ($C_1$-$C_6$-alkoxy)-$C_1$-$C_6$-alkoxy, ($C_1$-$C_6$-alkoxy)-$C_2$-$C_6$-alkenyl, ($C_1$-$C_6$-alkoxy)-$C_2$-$C_6$-alkynyl, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, ($C_1$-$C_6$-alkyl)-carbonyloxy, $C_3$-$C_6$-cycloalkyl, $C_3$-$C_6$-cycloalkoxy, ($C_3$-$C_6$-cycloalkyl)-$C_1$-$C_4$-alkyl, ($C_3$-$C_6$-cycloalkyl)-$C_1$-$C_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups, for q=2 or 3 it being possible that $R^b$ are identical or different;

$R^c$ is selected from the group consisting of H, OH, $S(O)_2NH_2$, CN, $C_1$-$C_6$-alkyl, $C_2$-$C_6$-alkenyl, $C_2$-$C_6$-alkynyl, $C_3$-$C_6$-cycloalkyl, $C_3$-$C_6$-cycloalkoxy, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 16 aforementioned radicals are unsubstituted, partly or completely halogenated, $R^d$ is selected from the group consisting of H, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl, where the aliphatic and cycloaliphatic parts of the 8 aforementioned radicals are unsubstituted, partly or completely halogenated;

$R^1$ is selected from the group consisting of H, OH, $S(O)_2NH_2$, CN, $C_3$-$C_6$-cycloalkyl, $C_3$-$C_6$-cycloalkoxy, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)-carbonyl, ($C_3$-$C_6$-cycloalkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 17 aforementioned radicals are unsubstituted, partly or completely halogenated, phenyl, phenyl-$C_1$-$C_6$-alkyl, phenylsulfonyl, phenylaminosulfonyl, phenylaminocarbonyl, phenyl($C_1$-$C_6$-alkyl)aminocarbonyl, phenylcarbonyl and phenoxycarbonyl, wherein phenyl in the last 8 mentioned radicals are unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

$R^2$ is selected from the group consisting of H, OH, $S(O)_2NH_2$, CN, $C_3$-$C_6$-cycloalkyl, $C_3$-$C_6$-cycloalkoxy, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)carbonyl, ($C_3$-$C_6$-cycloalkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 17 aforementioned radicals are unsubstituted, partly or completely halogenated, phenyl, phenylsulfonyl, phenylaminosulfonyl, phenyl-$C_1$-$C_6$ alkyl phenoxy, phenylaminocarbonyl, phenyl($C_1$-$C_6$-alkyl)aminocarbonyl, phenylcarbonyl and phenoxycarbonyl wherein phenyl in the last 8 mentioned radicals is unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

X is a radical selected from the group consisting of $CR^3R^4R^5$ phenyl which is unsubstituted or carries 1, 2, 3, 4 or 5 radicals $R^{Ar}$ which are identical or different;

$NR^{3a}R^{3b}$, $OR^{3c}$ and $S(O)_kR^{3d}$ with k being 0, 1 or 2, wherein $R^3$ is selected from the group consisting of H, halogen, OH, CN, $C_1$-$C_6$-alkyl, ($C_1$-$C_6$-alkoxy)-$C_1$-$C_6$-alkyl, $C_3$-$C_6$-cycloalkyl, ($C_1$-$C_4$-cycloalkyl)-$C_1$-$C_4$-alkyl $C_1$-$C_6$-alkoxy, $C_2$-$C_6$-alkenyloxy, $C_2$-$C_6$-alkynyloxy, $C_3$-$C_6$-cydoalkoxy, ($C_1$-$C_4$-cycloalkyl)-$C_1$-$C_4$-alkoxy, where the aliphatic and cycloaliphatic parts of the 9 aforementioned radicals are unsubstituted, partly or completely halogenated;

$R^4$ is selected from the group consisting of H, halogen, CN, $C_1$-$C_6$-alkyl, $C_1$-$C_6$-haloalkyl, $C_1$-$C_6$-alkoxy and $C_1$-$C_6$-haloalkoxy;

$R^5$ is selected from the group consisting of halogen, CN, $C_1$-$C_6$-alkyl, $C_2$-$C_6$-alkenyl, $C_3$-$C_6$-alkynyl, $C_3$-$C_6$-cycloalkyl, ($C_3$-$C_6$-cycloalkyl)-$C_3$-$C_6$-alkyl $C_3$-$C_6$-cycloalkenyl and $C_1$-$C_6$-alkoxy-$C_1$-$C_6$-alkyl, where the aliphatic and cycloaliphatic parts of the 7 aforementioned radicals are unsubstituted, partly or completely halogenated;

$R^4$ and $R^5$ together with the carbon atom to which they are attached form a moiety selected from the group consisting of carbonyl thiocarbonyl, $C_3$-$C_6$-cycloalkyl $C_3$-$C_6$cycloalkenyl, three- to six-membered saturated or partially unsaturated heterocyclyl, and the moiety $>C=CR^xR^y$, where $R^x$ and $R^y$ are hydrogen, $C_1$-$C_6$-alkyl or $C_1$-$C_6$-haloalkyl;

$R^{Ar}$ selected from the group consisting of halogen, OH, CN, amino, $NO_2$, $C_1$-$C_6$-alkyl, $C_2$-$C_6$-alkenyl, $C_2$-$C_6$-alkynyl, $C_1$-$C_6$-alkoxy, $C_2$-$C_6$-alkenyloxy, $C_2$-$C_6$-alkynyloxy, ($C_1$-$C_6$-alkoxy)-$C_1$-$C_6$-alkyl ($C_1$-$C_6$-alkoxy)-$C_1$-$C_6$-alkoxy, ($C_1$-$C_6$alkoxy)-$C_2$-$C_6$-alkenyl, ($C_1$-$C_6$-alkoxy)-$C_2$-$C_6$-alkynyl, $C_1$-$C_6$-alkylthio, ($C_1$-$C_6$-alkyl)sulfinyl, ($C_1$-$C_6$-alkyl)sulfonyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, ($C_1$-$C_6$-alkyl)-carbonyloxy, $C_3$-$C_6$-cycloalkyl, $C_3$-$C_6$-cycloalkoxy, ($C_3$-$C_6$-cycloalkyl)-$C_1$-$C_6$-alkyl ($C_1$-$C_6$-cycloalkyl)-$C_1$-$C_4$-alkoxy, where the aliphatic and cycloaliphatic parts of the 22 aforementioned radicals are unsubstituted, partly or completely halogenated and where the cycloaliphatic parts of the last 4 mentioned radicals may carry 1, 2, 3, 4, 5 or 6 methyl groups, $R^{3a}$, $R^{3b}$, $R^{3c}$ or $R^{3d}$ are independently of one another are selected from the group consisting of H, CN, $S(O)_2NH_2$, $C_1$-$C_6$-alkyl, $C_1$-$C_6$-alkoxy, $C_2$-$C_6$-alkenyl, $C_2$-$C_6$-alkynyl, $C_3$-$C_6$-cycloalkyl, ($C_3$-$C_6$-cycloalkyl)-$C_1$-$C_6$-alkyl, ($C_1$-$C_6$-alkoxy)-$C_1$-$C_6$-alkyl, ($C_1$-$C_6$-alkyl)-carbonyl, ($C_3$-$C_6$-cycloalkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 16 aforementioned radicals are unsubstituted, partly or completely halogenated, phenyl, phenylsulfonyl, phenyl-$C_1$-$C_6$ alkyl, phenylaminosulfonyl, phenylcarbonyl and phenoxycarbonyl, wherein phenyl in the last 6 mentioned radicals is unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy, or $R^{3a}$, $R^{3b}$ together with the nitrogen atom, to which they are bound, form an N-bound, mono- or bicyclic heterocyclic radical, which may have 1, 2, 3 or 4 further heteroatoms which are selected from N, O and S, which is unsubstituted or substituted by one or more identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy, one of $R^{3a}$, $R^{3b}$ may also be OH, $C_1$-$C_6$-alkoxy, $C_3$-$C_6$-cycloalkoxy, ($C_3$-$C_6$-cycloalkyl)-$C_1$-$C_4$-alkoxy, $C_2$-$C_6$-alkenyloxy, $C_2$-$C_6$-alkynyloxy, ($C_1$-$C_6$-alkoxy)-$C_1$-$C_6$-alkoxy, where the aliphatic and cycloaliphatic parts of the 6 aforementioned radicals are unsubstituted, partly or completely halogenated, or phenoxy, which is unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

including their agriculturally acceptable salts.

In another preferred embodiment, the azines useful for the present invention comprise a diaminotriazine compound of formula (I)

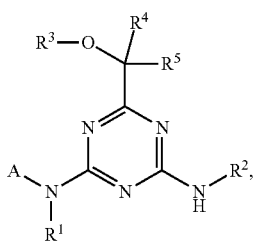

(I)

wherein

A is phenyl, which is substituted by fluorine in the ortho-position and which may additionally carry 1, 2, 3 or 4 identical or different substituents $R^4$ selected from the group consisting of halogen, OH, CN, amino, $NO_2$, $C_1$-$C_6$-alkyl, $C_2$-$C_6$-alkenyl, $C_2$-$C_6$-alkynyl, ($C_1$-$C_6$-alkoxy)-$C_2$-$C_6$-alkyl, ($C_1$-$C_6$-alkoxy)-$C_2$-$C_6$-alkenyl, ($C_1$-$C_6$-alkoxy)-$C_2$-$C_6$-alkynyl, ($C_1$-$C_6$-alkyl)amino, di($C_1$-$C_6$-alkyl)amino, ($C_1$-$C_6$-alkyl)-carbonyl, ($C_1$-$C_6$-alkoxy)-carbonyl, $C_3$-$C_6$-cycloalkyl, ($C_3$-$C_6$-cycloalkyl)-$C_1$-$C_4$-alkyl, where the aliphatic and cycloaliphatic parts of the 11 aforementioned radicals are unsubstituted, partly or completely halogenated and where the cycloaliphatic parts of the last 4 mentioned radicals may carry 1, 2, 3, 4, 5 or 6 methyl groups;

$R^1$ is selected from the group consisting of H, OH, $S(O)_2NH_2$, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)-carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 14 aforementioned radicals are unsubstituted, partly or completely halogenated, phenyl, phenyl-$C_1$-$C_6$-alkyl, phenylsulfonyl, phenylaminosulfonyl, phenylcarbonyl and phenoxycarbonyl, wherein phenyl in the last 6 mentioned radicals are unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

$R^2$ is selected from the group consisting of H, OH, $S(O)_2NH_2$, CN, $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, $C_1$-$C_6$-alkoxy, ($C_1$-$C_6$-alkoxy)-$C_1$-$C_6$-alkyl, ($C_1$-$C_6$-alkyl)carbonyl, ($C_1$-$C_6$-alkoxy)carbonyl, ($C_1$-$C_6$-alkyl)sulfonyl, ($C_1$-$C_6$-alkylamino)carbonyl, di($C_1$-$C_6$-alkyl)aminocarbonyl, ($C_1$-$C_6$-alkylamino)sulfonyl, di($C_1$-$C_6$-alkyl)aminosulfonyl and ($C_1$-$C_6$-alkoxy)sulfonyl, where the aliphatic and cycloaliphatic parts of the 14 aforementioned radicals are unsubstituted, partly or completely halogenated, phenyl, phenylsulfonyl, phenylaminosulfonyl, phenyl-$C_1$-$C_6$ alkyl, phenoxy, phenylcarbonyl and phenoxycarbonyl, wherein phenyl in the last 6 mentioned radicals is unsubstituted or substituted by 1, 2, 3, 4 or 5 identical or different substituents selected from the group consisting of halogen, CN, $NO_2$, $C_1$-$C_6$-alkyl, $C_1$-$C_6$-haloalkyl, $C_1$-$C_6$-alkoxy and $C_1$-$C_6$-haloalkoxy;

$R^3$ is selected from the group consisting of $C_1$-$C_6$-alkyl, $C_2$-$C_6$-alkenyl, $C_2$-$C_6$-alkynyl, ($C_3$-$C_6$-cycloalkyl)-$C_1$-$C_4$-alkyl, ($C_1$-$C_6$-alkoxy)-$C_1$-$C_6$-alkyl, ($C_1$-$C_6$-alkyl)carbonyl, ($C_1$-$C_6$-alkoxy)carbonyl, ($C_1$-$C_6$-alkylamino)carbonyl and di($C_1$-$C_6$-alkyl)aminocarbonyl, where the aliphatic and cycloaliphatic parts of the 9 aforementioned radicals are unsubstituted, partly or completely halogenated, $R^4$ and $R^5$, together with the carbon atom, to which they are bound form a saturated 3-, 4-, 5- or 6-membered carbocyclic radical or a saturated 3-, 4-, 5- or 6-membered heterocyclic radical, where the carbocyclic radical and the heterocyclic radical are unsubstituted, partly or completely halogenated or carry from 1 to 6 $C_1$-$C_6$-alkyl groups;

including their agriculturally acceptable salts.

The herbicidal compounds (component A) useful for the present invention as disclosed SUPRA may further be used in conjunction with additional herbicides to which the crop plant is naturally tolerant or to which has been made tolerant by mutagenesis as described SUPRA, or to which it is resistant via expression of one or more additional transgenes as mentioned supra. The CESA-inhibiting herbicides useful for the present invention are often best applied in conjunction with one or more other herbicides to obtain control of a wider variety of undesirable vegetation. When used in conjunction with other herbicides (hereinafter referred to a compound B), the presently claimed compounds can be formulated with the other herbicide or herbicides, tank mixed with the other herbicide or herbicides, or applied sequentially with the other herbicide or herbicides.

The further herbicidal compound B (component B) is in particular selected from the herbicides of class b1) to b15):

b1) lipid biosynthesis inhibitors;
b2) acetolactate synthase inhibitors (ALS inhibitors);
b3) photosynthesis inhibitors;
b4) protoporphyrinogen-IX oxidase inhibitors,
b5) bleacher herbicides;
b6) enolpyruvyl shikimate 3-phosphate synthase inhibitors (EPSP inhibitors);
b7) glutamine synthetase inhibitors;
b8) 7,8-dihydropteroate synthase inhibitors (DHP inhibitors);
b9) mitosis inhibitors;
b10) inhibitors of the synthesis of very long chain fatty acids (VLCFA inhibitors);
b11) cellulose biosynthesis inhibitors;
b12) decoupler herbicides;
b13) auxinic herbicides;
b14) auxin transport inhibitors; and
b15) other herbicides selected from the group consisting of bromobutide, chloroflurenol, chloroflurenol-methyl, cinmethylin, cumyluron, dalapon, dazomet, difenzoquat, difenzoquat-metilsulfate, dimethipin, DSMA, dymron, endothal and its salts, etobenzanid, flamprop, flamprop-isopropyl, flamprop-methyl, flamprop-M-isopropyl, flamprop-M-methyl, flurenol, flurenol-butyl, flurprimidol, fosamine, fosamine-ammonium, indanofan, indaziflam, maleic hydrazide, mefluidide, metam, methiozolin (CAS 403640-27-7), methyl azide, methyl bromide, methyl-dymron, methyl iodide, MSMA, oleic acid, oxaziclomefone, pelargonic acid, pyributicarb, quinoclamine, triaziflam, tridiphane and 6-chloro-3-(2-cyclopropyl-6-methylphenoxy)-4-pyridazinol (CAS 499223-49-3) and its salts and esters;

including their agriculturally acceptable salts or derivatives such as ethers, esters or amides.

Preference is given to those compositions according to the present invention comprising at least one herbicide B selected from herbicides of class b1, b6, b9, b10 and b11.

Examples of herbicides B which can be used in combination with the compounds of formula (I) according to the present invention are:

b1) from the group of the lipid biosynthesis inhibitors:

ACC-herbicides such as alloxydim, alloxydim-sodium, butroxydim, clethodim, clodinafop, clodinafop-propargyl, cycloxydim, cyhalofop, cyhalofop-butyl, diclofop, diclofop-methyl, fenoxaprop, fenoxaprop-ethyl, fenoxaprop-P, fenoxaprop-P-ethyl, fluazifop, fluazifop-butyl, fluazifop-P, fluazifop-P-butyl, haloxyfop, haloxyfop-methyl, haloxyfop-P, haloxyfop-P-methyl, metamifop, pinoxaden, profoxydim, propaquizafop, quizalofop, quizalofop-ethyl, quizalofop-tefuryl, quizalofop-P, quizalofop-P-ethyl, quizalofop-P-tefuryl, sethoxydim, tepraloxydim, tralkoxydim, 4-(4'-Chloro-4-cyclopropyl-2'-fluoro[1,1'-biphenyl]-3-yl)-5-hydroxy-2,2,6,6-tetramethyl-2H-pyran-3(6H)-one (CAS 1312337-72-6); 4-(2',4'-Dichloro-4-cyclopropyl[1,1'-biphenyl]-3-yl)-5-hydroxy-2,2,6,6-tetramethyl-2H-pyran-3(6H)-one (CAS 1312337-45-3); 4-(4'-Chloro-4-ethyl-2'-fluoro[1,1'-biphenyl]-3-yl)-5-hydroxy-2,2,6,6-tetramethyl-2H-pyran-3(6H)-one (CAS 1033757-93-5); 4-(2',4'-Dichloro-4-ethyl[1,1'-biphenyl]-3-yl)-2,2,6,6-tetramethyl-2H-pyran-3,5(4H,6H)-dione (CAS 1312340-84-3); 5-(Acetyloxy)-4-(4'-chloro-4-cyclopropyl-2'-fluoro[1,1'-biphenyl]-3-yl)-3,6-dihydro-2,2,6,6-tetramethyl-2H-pyran-3-one (CAS 1312337-48-6); 5-(Acetyloxy)-4-(2',4'-dichloro-4-cyclopropyl-[1,1'-biphenyl]-3-yl)-3,6-dihydro-2,2,6,6-tetramethyl-2H-pyran-3-one; 5-(Acetyloxy)-4-(4'-chloro-4-ethyl-2'-fluoro[1,1'-biphenyl]-3-yl)-3,6-dihydro-2,2,6,6-tetramethyl-2H-pyran-3-one (CAS 1312340-82-1); 5-(Acetyloxy)-4-(2',4'-dichloro-4-ethyl[1,1'-biphenyl]-3-yl)-3,6-dihydro-2,2,6,6-tetramethyl-2H-pyran-3-one (CAS 1033760-55-2); 4-(4'-Chloro-4-cyclopropyl-2'-fluoro[1,1'-biphenyl]-3-yl)-5,6-dihydro-2,2,6,6-tetramethyl-5-oxo-2H-pyran-3-yl carbonic acid methyl ester (CAS 1312337-51-1); 4-(2',4'-Dichloro-4-cyclopropyl-[1,1'-biphenyl]-3-yl)-5,6-dihydro-2,2,6,6-tetramethyl-5-oxo-2H-pyran-3-yl carbonic acid methyl ester; 4-(4'-Chloro-4-ethyl-2'-fluoro[1,1'-biphenyl]-3-yl)-5,6-dihydro-2,2,6,6-tetramethyl-5-oxo-2H-pyran-3-yl carbonic acid methyl ester (CAS 1312340-83-2); 4-(2',4'-Dichloro-4-ethyl[1,1'-biphenyl]-3-yl)-5,6-dihydro-2,2,6,6-tetramethyl-5-oxo-2H-pyran-3-yl carbonic acid methyl ester (CAS 1033760-58-5); and non ACC herbicides such as benfuresate, butylate, cycloate, dalapon, dimepiperate, EPTC, esprocarb, ethofumesate, flupropanate, molinate, orbencarb, pebulate, prosulfocarb, TCA, thiobencarb, tiocarbazil, triallate and vernolate;

b2) from the group of the ALS inhibitors:

sulfonylureas such as amidosulfuron, azimsulfuron, bensulfuron, bensulfuron-methyl, chlorimuron, chlorimuron-ethyl, chlorsulfuron, cinosulfuron, cyclosulfamuron, ethametsulfuron, ethametsulfuron-methyl, ethoxysulfuron, flazasulfuron, flucetosulfuron, flupyrsulfuron, flupyrsulfuron-methyl-sodium, foramsulfuron, halosulfuron, halosulfuron-methyl, imazosulfuron, iodosulfuron, iodosulfuron-methyl-sodium, iofensulfuron, iofensulfuron-sodium, mesosulfuron, metazosulfuron, metsulfuron, metsulfuron-methyl, nicosulfuron, orthosulfamuron, oxasulfuron, primisulfuron, primisulfuron-methyl, propyrisulfuron, prosulfuron, pyrazosulfuron, pyrazosulfuron-ethyl, rimsulfuron, sulfometuron, sulfometuron-methyl, sulfosulfuron, thifensulfuron, thifensulfuron-methyl, triasulfuron, tribenuron, tribenuron-methyl, trifloxysulfuron, triflusulfuron, triflusulfuron-methyl and tritosulfuron, imidazolinones such as imazamethabenz, imazamethabenz-methyl, imazamox, imazapic, imazapyr, imazaquin and imazethapyr, triazolopyrimidine herbicides and sulfonanilides such as cloransulam, cloransulam-methyl, diclosulam, flumetsulam, florasulam, metosulam, penoxsulam, pyrimisulfan and pyroxsulam, pyrimidinylbenzoates such as bispyribac, bispyribac-sodium, pyribenzoxim, pyriftalid, pyriminobac, pyriminobac-methyl, pyrithiobac, pyrithiobac-sodium, 4-[[[2-[(4,6-dimethoxy-2-pyrimidinyl)oxy]phenyl]methyl] amino]-benzoic acid-1-methylethyl ester (CAS 420138-41-6), 4-[[[2-[(4,6-dimethoxy-2-pyrimidinyl) oxy]phenyl]methyl]amino]-benzoic acid propyl ester (CAS 420138-40-5), N-(4-bromophenyl)-2-[(4,6-dimethoxy-2-pyrimidinyl)oxy]benzenemethanamine (CAS 420138-01-8), sulfonylaminocarbonyl-triazolinone herbicides such as flucarbazone, flucarbazone-sodium, propoxycarbazone, propoxycarbazone-sodium, thiencarbazone and thiencarbazone-methyl; and triafamone;

among these, a preferred embodiment of the invention relates to those compositions comprising at least one imidazolinone herbicide;

b3) from the group of the photosynthesis inhibitors:

amicarbazone, inhibitors of the photosystem II, e.g. triazine herbicides, including of chlorotriazine, triazinones, triazindiones, methylthiotriazines and pyridazinones such as ametryn, atrazine, chloridazon, cyanazine, desmetryn, dimethametryn, hexazinone, metribuzin, prometon, prometryn, propazine, simazine, simetryn, terbumeton, terbuthylazin, terbutryn and trietazin, aryl urea such as chlorobromuron, chlorotoluron, chloroxuron, dimefuron, diuron, fluometuron, isoproturon, isouron, linuron, metamitron, methabenzthiazuron, metobenzuron, metoxuron, monolinuron, neburon, siduron, tebuthiuron and thiadiazuron, phenyl carbamates such as desmedipham, karbutilat, phenmedipham, phenmedipham-ethyl, nitrile herbicides such as bromofenoxim, bromoxynil and its salts and esters, ioxynil and its salts and esters, uraciles such as bromacil, lenacil and terbacil, and bentazon and bentazon-sodium, pyridate, pyridafol, pentanochlor and propanil and inhibitors of the photosystem I such as diquat, diquat-dibromide, paraquat, paraquat-dichloride and paraquat-dimetilsulfate. Among these, a preferred embodiment of the invention relates to those compositions comprising at least one aryl urea herbicide. Among these, likewise a preferred embodiment of the invention relates to those compositions comprising at least one triazine herbicide. Among these, likewise a preferred embodiment of the invention relates to those compositions comprising at least one nitrile herbicide;

b4) from the group of the protoporphyrinogen-IX oxidase inhibitors:

acifluorfen, acifluorfen-sodium, azafenidin, bencarbazone, benzfendizone, bifenox, butafenacil, carfentrazone, carfentrazone-ethyl, chlomethoxyfen, cinidon-ethyl, fluazolate, flufenpyr, flufenpyr-ethyl, flumiclorac, flumiclorac-pentyl, flumioxazin, fluoroglycofen, fluoroglycofen-ethyl, fluthiacet, fluthiacet-methyl, fomesafen, halosafen, lactofen, oxadiargyl, oxadiazon, oxyfluorfen, pentoxazone, profluazol, pyraclonil, pyraflufen, pyraflufen-ethyl, saflufenacil, sulfentrazone, thidiazimin, tiafenacil, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione, 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione, methyl (E)-4-[2-chloro-5-[4-chloro-5-(difluoromethoxy)-1H-methyl-pyrazol-3-yl]-4-fluoro-phenoxy]-3-methoxy-but-2-enoate [CAS 948893-00-3], and 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4);

b5) from the group of the bleacher herbicides:
PDS inhibitors: beflubutamid, diflufenican, fluridone, flurochloridone, flurtamone, norflurazon, picolinafen, and 4-(3-trifluoromethylphenoxy)-2-(4-trifluoromethylphenyl)pyrimidine (CAS 180608-33-7), HPPD inhibitors: benzobicyclon, benzofenap, clomazone, fenquintrione, isoxaflutole, mesotrione, pyrasulfotole, pyrazolynate, pyrazoxyfen, sulcotrione, tefuryltrione, tembotrione, topramezone and bicyclopyrone, bleacher, unknown target: aclonifen, amitrole and flumeturon;

b6) from the group of the EPSP synthase inhibitors:
glyphosate, glyphosate-isopropylammonium, glyposate-potassium and glyphosate-trimesium (sulfosate);

b7) from the group of the glutamine synthase inhibitors:
bilanaphos (bialaphos), bilanaphos-sodium, glufosinate, glufosinate-P and glufosinate-ammonium;

b8) from the group of the DHP synthase inhibitors:
asulam;

b9) from the group of the mitosis inhibitors:
compounds of group K1: dinitroanilines such as benfluralin, butralin, dinitramine, ethalfluralin, fluchloralin, oryzalin, pendimethalin, prodiamine and trifluralin, phosphoramidates such as amiprophos, amiprophos-methyl, and butamiphos, benzoic acid herbicides such as chlorthal, chlorthal-dimethyl, pyridines such as dithiopyr and thiazopyr, benzamides such as propyzamide and tebutam; compounds of group K2: chlorpropham, propham and carbetamide, among these, compounds of group K1, in particular dinitroanilines are preferred;

b10) from the group of the VLCFA inhibitors:
chloroacetamides such as acetochlor, alachlor, butachlor, dimethachlor, dimethenamid, dimethenamid-P, metazachlor, metolachlor, metolachlor-S, pethoxamid, pretilachlor, propachlor, propisochlor and thenylchlor, oxyacetanilides such as flufenacet and mefenacet, acetanilides such as diphenamid, naproanilide, napropamide and napropamide-M, tetrazolinones such fentrazamide, and other herbicides such as anilofos, cafenstrole, fenoxasulfone, ipfencarbazone, piperophos, pyroxasulfone and isoxazoline compounds of the formulae II.1, II.2, II.3, II.4, II.5, II.6, II.7, II.8 and II.9

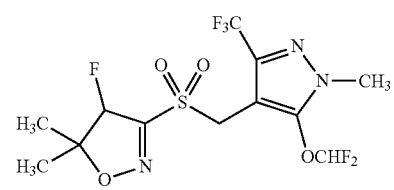

II.1

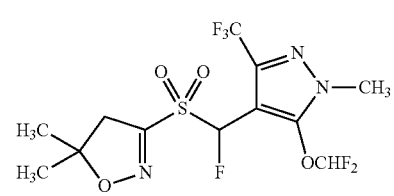

II.2

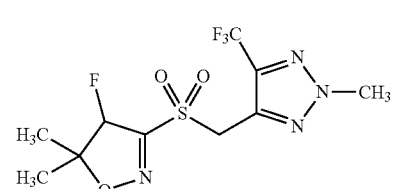

II.3

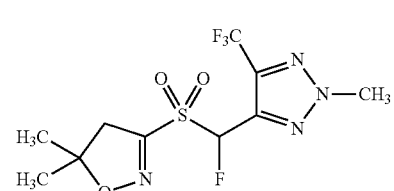

II.4

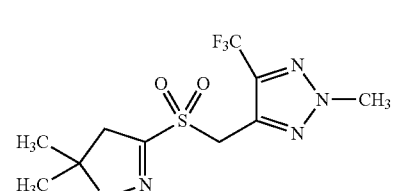

II.5

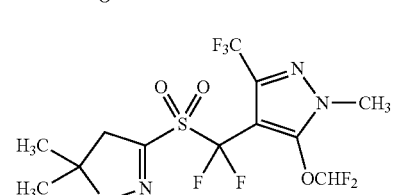

II.6

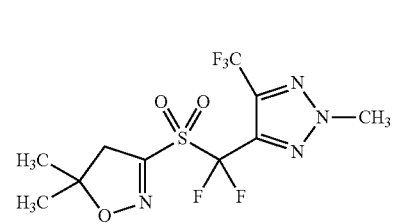

II.7

II.8
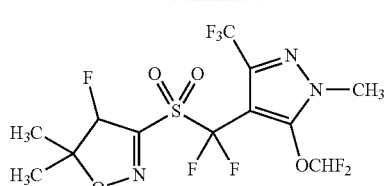

II.9
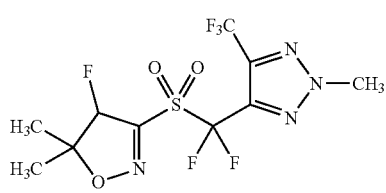

the isoxazoline compounds of the formula (I)I are known in the art, e.g. from WO 2006/024820, WO 2006/037945, WO 2007/071900 and WO 2007/096576;
among the VLCFA inhibitors, preference is given to chloroacetamides and oxyacetamides; b11) from the group of the cellulose biosynthesis inhibitors:
chlorthiamid, dichlobenil, flupoxam, isoxaben and 1-Cyclohexyl-5-pentafluorophenyloxy-1⁴-[1,2,4,6]thiatriazin-3-ylamine;

b12) from the group of the decoupler herbicides:
dinoseb, dinoterb and DNOC and its salts;

b13) from the group of the auxinic herbicides:
2,4-D and its salts and esters such as clacyfos, 2,4-DB and its salts and esters, aminocyclopyrachlor and its salts and esters, aminopyralid and its salts such as aminopyralid-dimethylammonium, aminopyralid-tris(2-hydroxypropyl)ammonium and its esters, benazolin, benazolin-ethyl, chloramben and its salts and esters, clomeprop, clopyralid and its salts and esters, dicamba and its salts and esters, dichlorprop and its salts and esters, dichlorprop-P and its salts and esters, fluroxypyr, fluroxypyr-butometyl, fluroxypyr-meptyl, halauxifen and its salts and esters (CAS 943832-60-8); MCPA and its salts and esters, MCPA-thioethyl, MCPB and its salts and esters, mecoprop and its salts and esters, mecoprop-P and its salts and esters, picloram and its salts and esters, quinclorac, quinmerac, TBA (2,3,6) and its salts and esters and triclopyr and its salts and esters;

b14) from the group of the auxin transport inhibitors:
diflufenzopyr, diflufenzopyr-sodium, naptalam and naptalam-sodium;

b15) from the group of the other herbicides: bromobutide, chlorflurenol, chlorflurenol-methyl, cinmethylin, cumyluron, cyclopyrimorate (CAS 499223-49-3) and its salts and esters, dalapon, dazomet, difenzoquat, difenzoquat-metilsulfate, dimethipin, DSMA, dymron, endothal and its salts, etobenzanid, flamprop, flamprop-isopropyl, flamprop-methyl, flamprop-M-isopropyl, flamprop-M-methyl, flurenol, flurenol-butyl, flurprimidol, fosamine, fosamine-ammonium, indanofan, indaziflam, maleic hydrazide, mefluidide, metam, methiozolin (CAS 403640-27-7), methyl azide, methyl bromide, methyl-dymron, methyl iodide, MSMA, oleic acid, oxaziclomefone, pelargonic acid, pyributicarb, quinoclamine, triaziflam and tridiphane.

Active compounds B and C having a carboxyl group can be employed in the form of the acid, in the form of an agriculturally suitable salt as mentioned above or else in the form of an agriculturally acceptable derivative in the compositions according to the invention.

In the case of dicamba, suitable salts include those, where the counterion is an agri-culturally acceptable cation. For example, suitable salts of dicamba are dicamba-sodium, dicamba-potassium, dicamba-methylammonium, dicamba-dimethylammonium, dicamba-isopropylammonium, dicamba-diglycolamine, dicamba-olamine, dicamba-diolamine, dicamba-trolamine, dicamba-N,N-bis-(3-aminopropyl)methylamine and dicamba-diethylenetriamine. Examples of a suitable ester are dicamba-methyl and dicamba-butotyl.

Suitable salts of 2,4-D are 2,4-D-ammonium, 2,4-D-dimethylammonium, 2,4-D-diethylammonium, 2,4-D-diethanolammonium (2,4-D-diolamine), 2,4-D-triethanol-ammonium, 2,4-D-isopropylammonium, 2,4-D-triisopropanolammonium, 2,4-D-heptylammonium, 2,4-D-dodecylammonium, 2,4-D-tetradecylammonium, 2,4-D-triethylammonium, 2,4-D-tris(2-hydroxypropyl)ammonium, 2,4-D-tris(isopropyl)ammonium, 2,4-D-trolamine, 2,4-D-lithium, 2,4-D-sodium. Examples of suitable esters of 2,4-D are 2,4-D-butotyl, 2,4-D-2-butoxypropyl, 2,4-D-3-butoxypropyl, 2,4-D-butyl, 2,4-D-ethyl, 2,4-D-ethylhexyl, 2,4-D-isobutyl, 2,4-D-isooctyl, 2,4-D-isopropyl, 2,4-D-meptyl, 2,4-D-methyl, 2,4-D-octyl, 2,4-D-pentyl, 2,4-D-propyl, 2,4-D-tefuryl and clacyfos.

Suitable salts of 2,4-DB are for example 2,4-DB-sodium, 2,4-DB-potassium and 2,4-DB-dimethylammonium. Suitable esters of 2,4-DB are for example 2,4-DB-butyl and 2,4-DB-isoctyl.

Suitable salts of dichlorprop are for example dichlorprop-sodium, dichlorprop-potassium and dichlorprop-dimethylammonium. Examples of suitable esters of dichlorprop are dichlorprop-butotyl and dichlorprop-isoctyl.

Suitable salts and esters of MCPA include MCPA-butotyl, MCPA-butyl, MCPA-dimethyl-ammonium, MCPA-diolamine, MCPA-ethyl, MCPA-thioethyl, MCPA-2-ethylhexyl, MCPA-isobutyl, MCPA-isoctyl, MCPA-isopropyl, MCPA-isopropylammonium, MCPA-methyl, MCPA-olamine, MCPA-potassium, MCPA-sodium and MCPA-trolamine.

A suitable salt of MCPB is MCPB sodium. A suitable ester of MCPB is MCPB-ethyl.

Suitable salts of clopyralid are clopyralid-potassium, clopyralid-olamine and clopyralid-tris-(2-hydroxypropyl) ammonium. Example of suitable esters of clopyralid is clopyralid-methyl.

Examples of a suitable ester of fluroxypyr are fluroxypyr-meptyl and fluroxypyr-2-butoxy-1-methylethyl, wherein fluroxypyr-meptyl is preferred.

Suitable salts of picloram are picloram-dimethylammonium, picloram-potassium, picloram-triisopropanolammonium, picloram-triisopropylammonium and picloram-trolamine. A suitable ester of picloram is picloram-isoctyl.

A suitable salt of triclopyr is triclopyr-triethylammonium. Suitable esters of triclopyr are for example triclopyr-ethyl and triclopyr-butotyl.

Suitable salts and esters of chloramben include chloramben-ammonium, chloramben-diolamine, chloramben-methyl, chloramben-methylammonium and chloramben-sodium.

Suitable salts and esters of 2,3,6-TBA include 2,3,6-TBA-dimethylammonium, 2,3,6-TBA-lithium, 2,3,6-TBA-potassium and 2,3,6-TBA-sodium.

Suitable salts and esters of aminopyralid include aminopyralid-potassium, aminopyralid-dimethylammonium, and aminopyralid-tris(2-hydroxypropyl)ammonium.

Suitable salts of glyphosate are for example glyphosate-ammonium, glyphosate-diammonium, glyphoste-dimethyl-ammonium, glyphosate-isopropylammonium, glyphosate-potassium, glyphosate-sodium, glyphosate-trimesium as well as the ethanolamine and diethanolamine salts, preferably glyphosate-diammonium, glyphosate-isopropylammonium and glyphosate-trimesium (sulfosate).

A suitable salt of glufosinate is for example glufosinate-ammonium.

A suitable salt of glufosinate-P is for example glufosinate-P-ammonium.

Suitable salts and esters of bromoxynil are for example bromoxynil-butyrate, bromoxynil-heptanoate, bromoxynil-octanoate, bromoxynil-potassium and bromoxynil-sodium.

Suitable salts and esters of ioxonil are for example ioxonil-octanoate, ioxonil-potassium and ioxonil-sodium.

Suitable salts and esters of mecoprop include mecoprop-butotyl, mecoprop-dimethylammonium, mecoprop-di-olamine, mecoprop-ethadyl, mecoprop-2-ethylhexyl, mecoprop-isoctyl, mecoprop-methyl, mecoprop-potassium, mecoprop-sodium and mecoprop-trolamine.

Suitable salts of mecoprop-P are for example mecoprop-P-butotyl, mecoprop-P-dimethylammonium, mecoprop-P-2-ethylhexyl, mecoprop-P-isobutyl, mecoprop-P-potassium and mecoprop-P-sodium.

A suitable salt of diflufenzopyr is for example diflufenzopyr-sodium.

A suitable salt of naptalam is for example naptalam-sodium.

Suitable salts and esters of aminocyclopyrachlor are for example aminocyclopyrachlor-dimethylammonium, aminocyclopyrachlor-methyl, aminocyclopyrachlor-triisopropanolammonium, aminocyclopyrachlor-sodium and aminocyclopyrachlor-potassium.

A suitable salt of quinclorac is for example quinclorac-dimethylammonium.

A suitable salt of quinmerac is for example quinclorac-dimethylammonium.

A suitable salt of imazamox is for example imazamox-ammonium.

Suitable salts of imazapic are for example imazapic-ammonium and imazapic-isopropylammonium.

Suitable salts of imazapyr are for example imazapyr-ammonium and imazapyr-isopropylammonium.

A suitable salt of imazaquin is for example imazaquin-ammonium.

Suitable salts of imazethapyr are for example imazethapyr-ammonium and imazethapyr-isopropylammonium.

A suitable salt of topramezone is for example topramezone-sodium.

Particularly preferred herbicidal compounds B are the herbicides B as defined above; in particular the herbicides B.1-B.189 listed below in table B:

TABLE B

| | Herbicide B |
|---|---|
| B.1 | clethodim |
| B.2 | clodinafop-propargyl |
| B.3 | cycloxydim |
| B.4 | cyhalofop-butyl |
| B.5 | fenoxaprop-ethyl |
| B.6 | fenoxaprop-P-ethyl |
| B.7 | metamifop |
| B.8 | pinoxaden |
| B.9 | profoxydim |
| B.10 | sethoxydim |
| B.11 | tepraloxydim |
| B.12 | tralkoxydim |
| B.13 | esprocarb |
| B.14 | ethofumesate |
| B.15 | molinate |
| B.16 | prosulfocarb |
| B.17 | thiobencarb |
| B.18 | triallate |
| B.19 | bensulfuron-methyl |
| B.20 | bispyribac-sodium |
| B.21 | cloransulam-methyl |
| B.22 | chlorsulfuron |
| B.23 | clorimuron |
| B.24 | cyclosulfamuron |
| B.25 | diclosulam |
| B.26 | florasulam |
| B.27 | flumetsulam |
| B.28 | flupyrsulfuron-methyl-sodium |
| B.29 | foramsulfuron |
| B.30 | imazamox |
| B.31 | imazamox-ammonium |
| B.32 | imazapic |
| B.33 | imazapic-ammonium |
| B.34 | imazapic-isopropylammonium |
| B.35 | imazapyr |
| B.36 | imazapyr-ammonium |
| B.37 | imazapyr-isopropylammonium |
| B.38 | imazaquin |
| B.39 | imazaquin-ammonium |
| B.40 | imazethapyr |
| B.41 | imazethapyr-ammonium |
| B.42 | imazethapyr-isopropylammonium |
| B.43 | imazosulfuron |
| B.44 | iodosulfuron-methyl-sodium |
| B.45 | iofensulfuron |
| B.46 | iofensulfuron-sodium |
| B.47 | mesosulfuron-methyl |
| B.48 | metazosulfuron |
| B.49 | metsulfuron-methyl |
| B.50 | metosulam |
| B.51 | nicosulfuron |
| B.52 | penoxsulam |
| B.53 | propoxycarbazon-sodium |
| B.54 | pyrazosulfuron-ethyl |
| B.55 | pyribenzoxim |
| B.56 | pyriftalid |
| B.57 | pyroxsulam |
| B.58 | propyrisulfuron |
| B.59 | rimsulfuron |
| B.60 | sulfosulfuron |
| B.61 | thiencarbazone-methyl |
| B.62 | thifensulfuron-methyl |
| B.63 | tribenuron-methyl |
| B.64 | tritosulfuron |
| B.65 | triafamone |
| B.66 | ametryne |
| B.67 | atrazine |
| B.68 | bentazon |
| B.69 | bromoxynil |
| B.70 | bromoxynil-octanoate |
| B.71 | bromoxynil-heptanoate |
| B.72 | bromoxynil-potassium |
| B.73 | diuron |
| B.74 | fluometuron |
| B.75 | hexazinone |
| B.76 | isoproturon |
| B.77 | linuron |
| B.78 | metamitron |
| B.79 | metribuzin |
| B.80 | propanil |
| B.81 | simazin |
| B.82 | terbuthylazine |
| B.83 | terbutryn |
| B.84 | paraquat-dichloride |
| B.85 | acifluorfen |
| B.86 | butafenacil |

TABLE B-continued

| | Herbicide B |
|---|---|
| B.87 | carfentrazone-ethyl |
| B.88 | flumioxazin |
| B.89 | fomesafen |
| B.90 | oxadiargyl |
| B.91 | oxyfluorfen |
| B.92 | saflufenacil |
| B.93 | sulfentrazone |
| B.94 | ethyl [3-[2-chloro-4-fluoro-5-(1-methyl-6-trifluoromethyl-2,4-dioxo-1,2,3,4-tetrahydro-pyrimidin-3-yl)phenoxy]-2-pyridyloxy]acetate (CAS 353292-31-6) |
| B.95 | 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) |
| B.96 | benzobicyclon |
| B.97 | clomazone |
| B.98 | diflufenican |
| B.99 | flurochloridone |
| B.100 | isoxaflutole |
| B.101 | mesotrione |
| B.102 | norflurazone |
| B.103 | picolinafen |
| B.104 | sulcotrione |
| B.105 | tefuryltrione |
| B.106 | tembotrione |
| B.107 | topramezone |
| B.108 | topramezone-sodium |
| B.109 | bicyclopyrone |
| B.110 | amitrole |
| B.111 | fluometuron |
| B.112 | fenquintrione |
| B.113 | glyphosate |
| B.114 | glyphosate-ammonium |
| B.115 | glyphosate-dimethylammonium |
| B.116 | glyphosate-isopropylammonium |
| B.117 | glyphosate-trimesium (sulfosate) |
| B.118 | glyphosate-potassium |
| B.119 | glufosinate |
| B.120 | glufosinate-ammonium |
| B.121 | glufosinate-P |
| B.122 | glufosinate-P-ammonium |
| B.123 | pendimethalin |
| B.124 | trifluralin |
| B.125 | acetochlor |
| B.126 | butachlor |
| B.127 | cafenstrole |
| B.128 | dimethenamid-P |
| B.129 | fentrazamide |
| B.130 | flufenacet |
| B.131 | mefenacet |
| B.132 | metazachlor |
| B.133 | metolachlor |
| B.134 | S-metolachlor |
| B.135 | pretilachlor |
| B.136 | fenoxasulfone |
| B.137 | isoxaben |
| B.138 | ipfencarbazone |
| B.139 | pyroxasulfone |
| B.140 | 2,4-D |
| B.141 | 2,4-D-isobutyl |
| B.142 | 2,4-D-dimethylammonium |
| B.143 | 2,4-D-N,N,N-trimethylethanolammonium |
| B.144 | aminopyralid |
| B.145 | aminopyralid-methyl |
| B.146 | aminopyralid-dimethyl-ammonium |
| B.147 | aminopyralid-tris(2-hydroxypropyl)ammonium |
| B.148 | clopyralid |
| B.149 | clopyralid-methyl |
| B.150 | clopyralid-olamine |
| B.151 | dicamba |
| B.152 | dicamba-butotyl |
| B.153 | dicamba-diglycolamine |
| B.154 | dicamba-dimethylammonium |
| B.155 | dicamba-diolamine |
| B.156 | dicamba-isopropylammonium |
| B.157 | dicamba-potassium |
| B.158 | dicamba-sodium |
| B.159 | dicamba-trolamine |
| B.160 | dicamba-N,N-bis-(3-aminopropyl)methylamine |
| B.161 | dicamba-diethylenetriamine |
| B.162 | fluroxypyr |
| B.163 | fluroxypyr-meptyl |
| B.164 | MCPA |
| B.165 | MCPA-2-ethylhexyl |
| B.166 | MCPA-dimethylammonium |
| B.167 | quinclorac |
| B.168 | quinclorac-dimethylammonium |
| B.169 | quinmerac |
| B.170 | quinmerac-dimethylammonium |
| B.171 | aminocyclopyrachlor |
| B.172 | aminocyclopyrachlor-potassium |
| B.173 | aminocyclopyrachlor-methyl |
| B.174 | diflufenzopyr |
| B.175 | diflufenzopyr-sodium |
| B.176 | dymron |
| B.177 | indanofan |
| B.178 | indaziflam |
| B.179 | oxaziclomefone |
| B.180 | triaziflam |
| B.181 | II.1 |
| B.182 | II.2 |
| B.183 | II.3 |
| B.184 | II.4 |
| B.185 | II.5 |
| B.186 | II.6 |
| B.187 | II.7 |
| B.188 | II.8 |
| B.189 | II.9 |

Moreover, it may be useful to apply the compounds of formula (I) in combination with safeners and optionally with one or more further herbicides. Safeners are chemical compounds which prevent or reduce damage on useful plants without having a major impact on the herbicidal action of the compounds of the formula (I) towards unwanted plants. They can be applied either before sowings (e.g. on seed treatments, shoots or seedlings) or in the pre-emergence application or post-emergence application of the useful plant. The safeners and the compounds of formula (I) and optionally the herbicides B can be applied simultaneously or in succession.

Suitable safeners are e.g. (quinolin-8-oxy)acetic acids, 1-phenyl-5-haloalkyl-1H-1,2,4-triazol-3-carboxylic acids, 1-phenyl-4,5-dihydro-5-alkyl-1H-pyrazol-3,5-dicarboxylic acids, 4,5-dihydro-5,5-diaryl-3-isoxazol carboxylic acids, dichloroacetamides, alpha-oximinophenylacetonitriles, acetophenonoximes, 4,6-dihalo-2-phenylpyrimidines, N-[[4-(aminocarbonyl)phenyl]sulfonyl]-2-benzoic amides, 1,8-naphthalic anhydride, 2-halo-4-(haloalkyl)-5-thiazol carboxylic acids, phosphorthiolates and N-alkyl-O-phenyl-carbamates and their agriculturally acceptable salts and their agriculturally acceptable derivatives such amides, esters, and thioesters, provided they have an acid group.

Examples of preferred safeners C are benoxacor, cloquintocet, cyometrinil, cyprosulfamide, dichlormid, dicyclonon, dietholate, fenchlorazole, fenclorim, flurazole, fluxofenim, furilazole, isoxadifen, mefenpyr, mephenate, naphthalic anhydride, oxabetrinil, 4-(dichloroacetyl)-1-oxa-4-azaspiro [4.5]decane (MON4660, CAS 71526-07-3), 2,2,5-trimethyl-3-(dichloroacetyl)-1,3-oxazolidine (R-29148, CAS 52836-31-4) and N-(2-Methoxybenzoyl)-4-[(methylaminocarbonyl)amino]benzenesulfonamide (CAS 129531-12-0).

Particularly preferred safeners C are the following compounds C.1 to C.17

| C.1 | benoxacor | C.2 | cloquintocet |
|---|---|---|---|
| C.3 | cloquintocet-mexyl | C.4 | cyprosulfamide |
| C.5 | dichlormid | C.6 | fenchlorazole |
| C.7 | fenchlorazole-ethyl | C.8 | fenclorim |
| C.9 | furilazole | C.10 | isoxadifen |
| C.11 | isoxadifen-ethyl | C.12 | mefenpyr |
| C.13 | mefenpyr-diethyl | C.14 | naphtalic acid anhydride |
| C.15 | 4-(dichloroacetyl)-1-oxa-4-azaspiro[4.5]decane | C.16 | 2,2,5-trimethyl-3-(dichloroacetyl)-1,3-oxazolidine |
| C.17 | N-(2-Methoxybenzoyl)-4-[(methylaminocarbonyl)amino]benzenesulfonamide | | |

The active compounds B of groups b1) to b15) and the safener compounds C are known herbicides and safeners, see, for example, The Compendium of Pesticide Common Names (http://www.alanwood.net/pesticides/); Farm Chemicals Handbook 2000 volume 86, Meister Publishing Company, 2000; B. Hock, C. Fedtke, R. R. Schmidt, Herbizide [Herbicides], Georg Thieme Verlag, Stuttgart 1995; W. H. Ahrens, Herbicide Handbook, 7th edition, Weed Science Society of America, 1994; and K. K. Hatzios, Herbicide Handbook, Supplement for the 7th edition, Weed Science Society of America, 1998. 2,2,5-Trimethyl-3-(dichloroacetyl)-1,3-oxazolidine [CAS No. 52836-31-4] is also referred to as R-29148. 4-(Dichloroacetyl)-1-oxa-4-azaspiro [4.5]decane [CAS No. 71526-07-3] is also referred to as AD-67 and MON 4660.

The assignment of the active compounds to the respective mechanisms of action is based on current knowledge. If several mechanisms of action apply to one active compound, this substance was only assigned to one mechanism of action.

It is generally preferred to use the compounds of the invention in combination with herbicides that are selective for the crop being treated and which complement the spectrum of weeds controlled by these compounds at the application rate employed. It is further generally preferred to apply the compounds of the invention and other complementary herbicides at the same time, either as a combination formulation or as a tank mix.

In another embodiment, the present invention refers to a method for identifying a CESA-inhibiting herbicide by using a mutated CESA encoded by a nucleic acid which comprises the nucleotide sequence of SEQ ID NO: 84, 85, 86, 87, 88, 89, 90, 91, 92, 93, 94, 95, 96, 97, or 98, or a variant or derivative thereof.

Said method comprises the steps of:
a) generating a transgenic cell or plant comprising a nucleic acid encoding a mutated CESA, wherein the mutated CESA is expressed;
b) applying a CESA-inhibiting herbicide to the transgenic cell or plant of a) and to a control cell or plant of the same variety;
c) determining the growth or the viability of the transgenic cell or plant and the control cell or plant after application of said CESA-inhibiting herbicide, and
d) selecting "CESA-inhibiting herbicides" which confer reduced growth to the control cell or plant as compared to the growth of the transgenic cell or plant.

As described above, the present invention teaches compositions and methods for increasing the CESA-inhibiting tolerance of a crop plant or seed as compared to a wild-type variety of the plant or seed. In a preferred embodiment, the CESA-inhibiting tolerance of a crop plant or seed is increased such that the plant or seed can withstand a CESA-inhibiting herbicide application of preferably approximately 1-1000 g ai ha$^{-1}$, more preferably 1-200 g ai ha$^{-1}$, even more preferably 5-150 g ai ha$^{-1}$, and most preferably 10-100 g ai ha-1. As used herein, to "withstand" a CESA-inhibiting herbicide application means that the plant is either not killed or only moderately injured by such application. It will be understood by the person skilled in the art that the application rates may vary, depending on the environmental conditions such as temperature or humidity, and depending on the chosen kind of herbicide (active ingredient ai).

Pre- and/or Post-emergent weed control methods useful in various embodiments hereof utilize about >0.3× application rates of CESA-inhibiting herbicides; in some embodiments, this can be about, for example, >0.3×, >0.4×, >0.5×, >0.6×, >0.7×, >0.8×, >0.9×, or >1× of CESA-inhibiting herbicides. In one embodiment, CESA-inhibiting herbicides-tolerant plants of the present invention have tolerance to a pre- and/or post-emergant application of a CESA-inhibiting herbicides at an amount of about 25 to about 500 g ai/ha. In some embodiments, wherein the CESA-inhibiting herbicides-tolerant plant is a dicot (e.g., soy, cotton), the pre- and/or post-emergant application of the CESA-inhibiting herbicides is at an amount of about 25-250 g ai/ha. In another embodiment, wherein the CESA-inhibiting herbicides-tolerant plant is a monocot (e.g., maize, rice, sorghum), the pre- and/or post-emergant application of the CESA-inhibiting herbicides is at an amount of about 50-500 g ai/ha. In other embodiments, wherein the CESA-inhibiting herbicides-tolerant plant is a Brassica (e.g., canola), the pre- and/or post-emergant application of the CESA-inhibiting herbicides is at an amount of about 25-200 g ai/ha. In pre- and/or post-emergent weed control methods hereof, in some embodiments, the method can utilize CESA-inhibiting herbicides application rates at pre-emergent and/or about 7 to 10 days post-emergent. In another embodiment, the application rate can exceed 8×CESA-inhibiting herbicides; in some embodiments, the rate can be up to 4×CESA-inhibiting herbicides, though more typically it will be about 2.5× or less, or about 2× or less, or about 1× or less.

Furthermore, the present invention provides methods that involve the use of at least one CESA-inhibiting herbicide, optionally in combination with one or more herbicidal compounds B, and, optionally, a safener C, as described in detail supra.

In these methods, the CESA-inhibiting herbicide can be applied by any method known in the art including, but not limited to, seed treatment, soil treatment, and foliar treatment. Prior to application, the CESA-inhibiting herbicide can be converted into the customary formulations, for example solutions, emulsions, suspensions, dusts, powders, pastes and granules. The use form depends on the particular intended purpose; in each case, it should ensure a fine and even distribution of the compound according to the invention.

By providing plants having increased tolerance to CESA-inhibiting herbicide, a wide variety of formulations can be employed for protecting plants from weeds, so as to enhance plant growth and reduce competition for nutrients. A CESA-inhibiting herbicide can be used by itself for pre-emergence, post-emergence, pre-planting, and at-planting control of weeds in areas surrounding the crop plants described herein, or a CESA-inhibiting herbicide formulation can be used that contains other additives. The CESA-inhibiting herbicide can also be used as a seed treatment. Additives found in a CESA-inhibiting herbicide formulation include other herbicides, detergents, adjuvants, spreading agents, sticking agents, stabilizing agents, or the like. The CESA-inhibiting herbicide formulation can be a wet or dry preparation and can include, but is not limited to, flowable powders, emulsifiable concentrates, and liquid concentrates. The CESA-inhibiting herbicide and herbicide formulations can be applied in accordance with conventional methods, for example, by spraying, irrigation, dusting, or the like.

Suitable formulations are described in detail in PCT/EP2009/063387 and PCT/EP2009/063386, which are incorporated herein by reference.

As disclosed herein, the CESA nucleic acids of the invention find use in enhancing the CBI herbicide tolerance of plants that comprise in their genomes a gene encoding a herbicide-tolerant mutated CESA protein. Such a gene may be an endogenous gene or a transgene, as described above. Additionally, in certain embodiments, the nucleic acids of the present invention can be stacked with any combination of polynucleotide sequences of interest in order to create plants with a desired phenotype. For example, the nucleic acids of the present invention may be stacked with any other polynucleotides encoding polypeptides having pesticidal and/or insecticidal activity, such as, for example, the *Bacillus thuringiensis* toxin proteins (described in U.S. Pat. Nos. 5,366,892; 5,747,450; 5,737,514; 5,723,756; 5,593,881; and Geiser et al (1986) Gene 48: 109), 5-enolpyruvylshikimate-3-phosphate synthase (EPSPS), Glyphosate acetyl transferase (GAT), cytochrome P450 monooxygenase, phosphinothricin acetyltransferase (PAT), Acetohydroxyacid synthase (AHAS; EC 4.1.3.18, also known as acetolactate synthase or ALS), hydroxyphenyl pyruvate dioxygenase (HPPD), Phytoene desaturase (PD), Protoporphyrinogen oxidase (PPO) and dicamba degrading enzymes as disclosed in WO 02/068607, or phenoxyaceticacid- and phenoxypropionicacid-derivative degrading enzymes as disclosed in WO 2008141154 or WO 2005107437. The combinations generated can also include multiple copies of any one of the polynucleotides of interest.

Consequently, Herbicide-tolerant plants of the invention can be used in conjunction with an herbicide to which they are tolerant. Herbicides can be applied to the plants of the invention using any techniques known to those skilled in the art. Herbicides can be applied at any point in the plant cultivation process. For example, herbicides can be applied pre-planting, at planting, pre-emergence, post-emergence or combinations thereof. Herbicides may be applied to seeds and dried to form a layer on the seeds.

In some embodiments, seeds are treated with a safener, followed by a post-emergent application of a CESA-inhibiting herbicides. In one embodiment, the post-emergent application of the CESA-inhibiting herbicides is about 7 to 10 days following planting of safener-treated seeds. In some embodiments, the safener is cloquintocet, dichlormid, fluxofenim, or combinations thereof.

Methods of Controlling Weeds or Undesired Vegetation

In other aspects, the present invention provides a method for controlling weeds at a locus for growth of a plant or plant part thereof, the method comprising: applying a composition comprising a CESA-inhibiting herbicides to the locus.

In some aspects, the present invention provides a method for controlling weeds at a locus for growth of a plant, the method comprising: applying an herbicide composition comprising CESA-inhibiting herbicides to the locus; wherein said locus is: (a) a locus that contains: a plant or a seed capable of producing said plant; or (b) a locus that is to be after said applying is made to contain the plant or the seed; wherein the plant or the seed comprises in at least some of its cells a polynucleotide operably linked to a promoter operable in plant cells, the promoter capable of expressing a mutated CESA polypeptide encoded by the polynucleotide, the expression of the mutated CESA polypeptide conferring to the plant tolerance to CESA-inhibiting herbicides.

Herbicide compositions hereof can be applied, e.g., as foliar treatments, soil treatments, seed treatments, or soil drenches. Application can be made, e.g., by spraying, dusting, broadcasting, or any other mode known useful in the art.

In one embodiment, herbicides can be used to control the growth of weeds that may be found growing in the vicinity of the herbicide-tolerant plants invention. In embodiments of this type, an herbicide can be applied to a plot in which herbicide-tolerant plants of the invention are growing in vicinity to weeds. An herbicide to which the herbicide-tolerant plant of the invention is tolerant can then be applied to the plot at a concentration sufficient to kill or inhibit the growth of the weed. Concentrations of herbicide sufficient to kill or inhibit the growth of weeds are known in the art and are disclosed above.

In other embodiments, the present invention provides a method for controlling weeds in the vicinity of a CESA-inhibiting herbicides-tolerant plant of the invention. The method comprises applying an effective amount of a CESA-inhibiting herbicides to the weeds and to the herbicide-tolerant plant, wherein the plant has increased tolerance to CESA-inhibiting herbicide when compared to a wild-type plant. In some embodiments, the CESA-inhibiting herbicides-tolerant plants of the invention are preferably crop plants, including, but not limited to, sunflower, alfalfa, *Brassica* sp., soybean, cotton, safflower, peanut, tobacco, tomato, potato, wheat, rice, maize, sorghum, barley, rye, millet, and sorghum.

In other aspects, herbicide(s) (e.g., CESA-inhibiting herbicides) can also be used as a seed treatment. In some embodiments, an effective concentration or an effective amount of herbicide(s), or a composition comprising an effective concentration or an effective amount of herbicide(s) can be applied directly to the seeds prior to or during the sowing of the seeds. Seed Treatment formulations may additionally comprise binders and optionally colorants.

Binders can be added to improve the adhesion of the active materials on the seeds after treatment. In one embodiments, suitable binders are block copolymers EO/PO surfactants but also polyvinylalcoholsl, polyvinylpyrrolidones, polyacrylates, polymethacrylates, polybutenes, polyisobutylenes, polystyrene, polyethyleneamines, polyethyleneamides, polyethyleneimines (Lupasol®, Polymin®), polyethers, polyurethans, polyvinylacetate, tylose and copolymers derived from these polymers. Optionally, also colorants can be included in the formulation. Suitable colorants or dyes for seed treatment formulations are Rhodamin B, C.I. Pigment Red 112, C.I. Solvent Red 1, pigment blue 15:4, pigment blue 15:3, pigment blue 15:2, pigment blue 15: 1, pigment blue 80, pigment yellow 1, pigment yellow 13, pigment red 112, pigment red 48:2, pigment red 48:1, pigment red 57:1, pigment red 53:1, pigment orange 43, pigment orange 34, pigment orange 5, pigment green 36, pigment green 7, pigment white 6, pigment brown 25, basic violet 10, basic violet 49, acid red 51, acid red 52, acid red 14, acid blue 9, acid yellow 23, basic red 10, basic red 108.

The term seed treatment comprises all suitable seed treatment techniques known in the art, such as seed dressing, seed coating, seed dusting, seed soaking, and seed pelleting. In one embodiment, the present invention provides a method of treating soil by the application, in particular into the seed drill: either of a granular formulation containing the CESA-inhibiting herbicides as a composition/formulation (e.g., a granular formulation), with optionally one or more solid or liquid, agriculturally acceptable carriers and/or optionally with one or more agriculturally acceptable surfactants. This method is advantageously employed, for example, in seedbeds of cereals, maize, cotton, and sunflower.

The present invention also comprises seeds coated with or containing with a seed treatment formulation comprising CESA-inhibiting herbicides and at least one other herbicide such as, e.g., an AHAS-inhibitor selected from the group consisting of amidosulfuron, azimsulfuron, bensulfuron, chlorimuron, chlorsulfuron, cinosulfuron, cyclosulfamuron, ethametsulfuron, ethoxysulfuron, flazasulfuron, flupyrsulfuron, foramsulfuron, halosulfuron, imazosulfuron, iodosulfuron, mesosulfuron, metsulfuron, nicosulfuron, oxasulfuron, primisulfuron, prosulfuron, pyrazosulfuron, rimsulfuron, sulfometuron, sulfosulfuron, thifensulfuron, triasulfuron, tribenuron, trifloxysulfuron, triflusulfuron, tritosulfuron, imazamethabenz, imazamox, imazapic, imazapyr, imazaquin, imazethapyr, cloransulam, diclosulam, florasulam, flumetsulam, metosulam, penoxsulam, bispyribac, pyriminobac, propoxycarbazone, flucarbazone, pyribenzoxim, pyriftalid and pyrithiobac.

The term "coated with and/or containing" generally signifies that the active ingredient is for the most part on the surface of the propagation product at the time of application, although a greater or lesser part of the ingredient may penetrate into the propagation product, depending on the method of application. When the said propagation product is (re)planted, it may absorb the active ingredient.

In some embodiments, the seed treatment application with CESA-inhibiting herbicides or with a formulation comprising the CESA-inhibiting herbicides is carried out by spraying or dusting the seeds before sowing of the plants and before emergence of the plants.

In other embodiments, in the treatment of seeds, the corresponding formulations are applied by treating the seeds with an effective amount of CESA-inhibiting herbicides or a formulation comprising the CESA-inhibiting herbicides.

In other aspects, the present invention provides a method for combating undesired vegetation or controlling weeds comprising contacting the seeds of the CESA-inhibiting herbicides-tolerant plants of the present invention before sowing and/or after pregermination with CESA-inhibiting herbicides. The method can further comprise sowing the seeds, for example, in soil in a field or in a potting medium in greenhouse. The method finds particular use in combating undesired vegetation or controlling weeds in the immediate vicinity of the seed. The control of undesired vegetation is understood as the killing of weeds and/or otherwise retarding or inhibiting the normal growth of the weeds. Weeds, in the broadest sense, are understood as meaning all those plants which grow in locations where they are undesired.

The weeds of the present invention include, for example, dicotyledonous and monocotyledonous weeds. Dicotyledonous weeds include, but are not limited to, weeds of the genera: *Sinapis, Lepiclium, Galium, Stellaria, Matricaria, Anthemis, Galinsoga, Chenopodium, Urtica, Senecio, Amaranthus, Portulaca, Xanthium, Convolvulus, Ipomoea, Polygonum, Sesbania, Ambrosia, Cirsium, Carduus, Sonchus, Solarium, Rorippa, Rotala, Lindernia, Lamium, Veronica, Abutilon, Emex, Datura, Viola, Galeopsis, Papaver, Centaurea, Trifolium, Ranunculus*, and *Taraxacum*. Monocotyledonous weeds include, but are not limited to, weeds of the genera: *Echinochloa, Setaria, Panicum, Digitaria, Phleum, Poa, Festuca, Eleusine, Brachiaria, Lolium, Bromus, Avena, Cyperus, Sorghum, Agropyron, Cynodon, Monochoria, Fimbristyslis, Sagittaria, Eleocharis, Scirpus, Paspalum, Ischaemum, Sphenoclea, Dactyloctenium, Agrostis, Alopecurus*, and *Apera*.

In addition, the weeds of the present invention can include, for example, crop plants that are growing in an undesired location. For example, a volunteer maize plant that is in a field that predominantly comprises soybean plants can be considered a weed, if the maize plant is undesired in the field of soybean plants.

In other embodiments, in the treatment of seeds, the corresponding formulations are applied by treating the seeds with an effective amount of CESA-inhibiting herbicides or a formulation comprising the CESA-inhibiting herbicides.

In still further aspects, treatment of loci, plants, plant parts, or seeds of the present invention comprises application of an agronomically acceptable composition that does not contain an A.I. In one embodiment, the treatment comprises application of an agronomically acceptable composition that does not contain a CESA-inhibiting herbicides A.I. In some embodiments, the treatment comprises application of an agronomically acceptable composition that does not contain a CESA-inhibiting herbicides A.L, wherein the composition comprises one or more of agronomically-acceptable carriers, diluents, excipients, plant growth regulators, and the like. In other embodiments, the treatment comprises application of an agronomically acceptable composition that does not contain a CESA-inhibiting herbicides A.I., wherein the composition comprises an adjuvant. In one embodiment, the adjuvant is a surfactant, a spreader, a sticker, a penetrant, a drift-control agent, a crop oil, an emulsifier, a compatibility agent, or combinations thereof.

It should also be understood that the foregoing relates to preferred embodiments of the present invention and that numerous changes may be made therein without departing from the scope of the invention. The invention is further illustrated by the following examples, which are not to be construed in any way as imposing limitations upon the scope thereof. On the contrary, it is to be clearly understood that resort may be had to various other embodiments, modifications, and equivalents thereof, which, after reading the description herein, may suggest themselves to those skilled in the art without departing from the spirit of the present invention and/or the scope of the appended claims.

EXAMPLES

Example 1: Identification of Cellulose Biosynthesis Inhibitor (CBI; CESA Inhibitor) Resistant Plants For selection of cellulose biosynthesis inhibitor resistant plants EMS mutagenized seed populations of *Arabidopsis thaliana* are used. EMS mutagenized seed populations are either bought from Lehle Seeds (1102 South Industrial Blvd. Suite D, Round Rock, Texas USA) or are generated as described elsewhere (Heim D R, et al. (1989) Plant Physiol. 90: 146-150). Causative mutations in CESA wildtype sequences (e.g. SEQ ID NO: 1 or 3) are identified as described by Scheible W R et al. (2001, Proc. Natl. Acad. of Sci. 98: 10079-10084), McCourt et. al. (WO2013/142968) or with the use of next generation sequencing methods as described by Austin R S, et al. (2011) Plant Journal 67: 715-725.

Selected *Arabidopsis thaliana* lines were assayed for improved resistance to azines like 6-cyclopentyl-N4-(2,3,4,5,6-pentafluorophenyl)-1,3,5-triazine-2,4-diamine; 6-(1-fluoro-1-methyl-ethyl)-N4-(2,3,4,5,6-pentafluorophenyl)-1,3,5-triazine-2,4-diamine; 6-cyclohexyl-N2-(2,3,4,5,6-pentafluorophenyl)-1,3,5-triazine-2,4-diamine; 6-(2,6-difluorophenyl)-N2-(2,3,5,6-tetrafluorophenyl)-1,3,5-triazine-2,4-diamine; N2-(4-chloro-3,5,6-trifluoro-2-pyridyl)-6-(1-fluoro-1-methyl-ethyl)-1,3,5-triazine-2,4-diamine in 48-well plates. Therefore, M2 or M3 seeds are surface sterilized by stirring for 5 min in ethanol+water (70+30 by volume), rinsing one time with ethanol+water (70+30 by volume) and two times with sterile, deionized water. The seeds are resuspended in 0.1% agar dissolved in water (w/v) Four to five seeds per well are plated on solid nutrient medium consisting of half-strength murashige skoog nutrient solution, pH 5.8 (Murashige and Skoog (1962) *Physiologia Plantarum* 15: 473-497). Compounds are dissolved in dimethylsulfoxid (DMSO) and added to the medium prior solidification (final DMSO concentration 0.1%). Multi well plates are incubated in a growth chamber at 22° C., 75% relative humidity and 110 µmol Phot* $m^{-2}*s^{-1}$ with 14: 10 h light dark photoperiod. Growth inhibition is evaluated seven to ten days after seeding in comparison to wild type plants. Tolerance factors are calculated based on IC50 values of growth inhibition of transformed versus non-transformed or non-mutated *Arabidopsis* plants.

Additionally, M3 *Arabidopsis* seeds are tested for improved tolerance to CESA-inhibiting herbicides in greenhouse studies with azine compounds like e. g. N2-(4-chloro-3,5,6-trifluoro-2-pyridyl)-6-(1-fluorocyclopentyl)-1,3,5-triazine-2,4-diamine (Table E1-1, see also FIG. 3).

Example 2: Engineering Azine-Tolerant *Arabidopsis* Plants Having Wildtype or Mutated Cellulose Synthase Sequences For transformation of *Arabidopsis thaliana*, wildtype or mutated cellulose synthase sequences encoding for one of the following protein sequences SEQ ID NO: 1 or 3, are cloned with standard cloning techniques as described in Sambrook et al. (Molecular cloning (2001) Cold Spring Harbor Laboratory Press) in a binary vector containing resistance marker gene cassette (AHAS) and mutated cellulose synthase sequence (marked as GOI) in between ubiquitin promoter (PcUbi) and nopaline synthase terminator (NOS) sequence. Binary plasmids are introduced to *Agrobacterium tumefaciens* for plant transformation. *Arabidopsis thaliana* are transformed with wildtype or mutated cellulose synthase sequences by floral dip method as described by McElver and Singh (WO 2008/124495). Transgenic *Arabidopsis* plants are subjected to TaqMan analysis for analysis of the number of integration loci.

The tolerance phenotype evaluation of transgenic T1 *Arabidopsis thaliana* plants germinating on sand with an azine-herbicide are done 14-21 days after germination.

Transgenic *Arabidopsis thaliana* plants (T2) are assayed for improved tolerance to azine herbicides like e. g. 6-cyclopentyl-N4-(2,3,4,5,6-pentafluorophenyl)-1,3,5-triazine-2,4-diamine in 48-well plates. Therefore, T2 seeds are surface sterilized by stirring for 5 min in ethanol+water (70+30 by volume), rinsing one time with ethanol+water (70+30 by volume) and two times with sterile, deionized water. The seeds are resuspended in 0.1% agar dissolved in water (w/v) Four to five seeds per well are plated on solid nutrient medium consisting of half-strength murashige skoog nutrient solution, pH 5.8 (Murashige and Skoog (1962) *Physiologia Plantarum* 15: 473-497). Compounds are dissolved in dimethylsulfoxid (DMSO) and added to the medium prior solidification (final DMSO concentration 0.1%). Multi well plates are incubated in a growth chamber at 22° C., 75% relative humidity and 110 µmol Phot* $m^{-2}*s^{-1}$ with 14:10 h light:dark photoperiod. Growth inhibition is evaluated seven to ten days after seeding in comparison to wild type plants. Tolerance factors are calculated based on IC50 values of growth inhibition of transformed versus non-transformed *Arabidopsis* plants.

TABLE E1-1

M3 seeds containing a variant of *Arabidopsis thaliana* CESA gene. Plants were treated pre-emergent with the indicated amount of the mentioned compound and evaluated for injury 21 days after treatment. Shown are the phytotox values of several events.

| Compound | Event:/ application rate [g ai/ha] | wildtype | At_CESA1_R292H (SEQ ID 1 - Variant R292H) A | B |
|---|---|---|---|---|
| 1-[4-chloro-3-(2,2,3,3,3-pentafluoropropoxymethyl)phenyl]-5-phenyl-1,2,4-triazole-3-carboxamide | 250 | 100 | 100 | 100 |
|  | 125 | 100 | 100 | 100 |
|  | 31.25 | 99 | 80 | 52.5 |
|  | 7.8 | 12.5 | 7.5 | 25 |
| N2-(4-chloro-3,5,6-trifluoro-2-pyridyl)-6-(1-fluorocyclopentyl)-1,3,5-triazine-2,4-diamine | 4 | 100 | 94 | 87.5 |
|  | 2 | 98 | 45 | 17.5 |
|  | 1 | 65 | 10 | 0 |
|  | 0.5 | 60 | 10 | 5 |

TABLE E2-1

Relative tolerance rates of transgenic *Arabidopsis* plants as compared to non-transgenic *Arabidopsis* plants (non-transgenic = 1.0), treated with various cellulose biosynthesis inhibitors. Growth inhibition is evaluated seven to ten days after seeding in comparison to wild type plants.

| Construct | SEQ ID | Variant | N2-(4-chloro-3,5,6-trifluoro-2-pyridyl)-6-(1-fluorocyclopentyl)-1,3,5-triazine-2,4-diamine | 6-cyclopentyl-N4-(2,3,4,5,6-pentafluorophenyl)-1,3,5-triazine-2,4-diamine | 1-(m-tolyl)-5-phenyl-1,2,4-triazole-3-carboxamide | 1-[4-chloro-3-(2,2,3,3,3-pentafluoropropoxymethyl)phenyl]-5-phenyl-1,2,4-triazole-3-carboxamide |
|---|---|---|---|---|---|---|
| AtCesA1_wt | 1 | — | 2 | 1 | 3 | |
| AtCesA1_G1031R | 1 | G1031R | 3 | 7 | 13 | |
| AtCesA3_wt | 3 | — | 1 | 1 | 4 | |
| AtCesA1_R292H | 1 | R292H | 1 | 3 | 31 | |
| AtCesA1_V297M | 1 | V297M | 1 | 1 | 5 | |
| AtCesA1_L1011A | 1 | L1011A | 1 | 3 | | 7 |
| AtCesA3_F1039L | 3 | F1039L | 1 | 3 | | 3 |

Example 3: Identification of Homologue Cellulose Synthase Isoforms in Crop Plants To identify homologue cellulose synthase genes from soy, corn and rice, BLAST searches using the protein sequences of *Arabidopsis thaliana* cellulose synthase isoforms were performed (Altschul et al. (1990) J Mol Biol 215: 403-10). Cellulose synthase protein encoding genes from corn, soy, rice, *Brassica napus* and sunflower were analyzed regarding their phylogenetic relationship by the R software library phangorn (Schliep K P. (2011) Bioinformatics 27: 592-593). Bootstrap analyses to statistically confirm monophyletic groups were calculated. In addition genes were classified by their expression level and expression pattern (Hruz T, et. al. (2008) Adv. in Bioinformatics 2008: 1-5) (FIG. 1-3) and selected for plant transformation. For plants species not available in Geninvestigator the genes are selected as follows. A cDNA library of e.g. *Brassica napus* seedlings were sequenced with one lane Illumina HiSeq2000 with a 2×100 bp paired end run using TruSeq SBS Kit v3 (FC-401-3001 Illumina Inc. San Diego, CA USA). The sequencing raw data were analyzed with FASTQC quality checker (Babraham Bioinformatics 2014), trimmed using EA-Utils fastq-mcf (https://code.google.com/p/ea-utils/) and further analyzed to remove any Illumina adaptor sequences using CutAdapt coding (http://code.google.com/p/cutadapt/). For relative expression analysis of the cellulose synthase genes in e.g. *Brassica napus*, reads were mapped using TopHat2 (Kim et al. 2013) and counted using HTseq count (Anders et al. 2015).

Example 4: Tissue Culture Conditions

An in vitro tissue culture mutagenesis assay is developed to isolate and characterize plant tissue (e.g., maize, rice) that is tolerant to cellulose synthase inhibiting herbicides, (e. g. 6-cyclopentyl-N4-(2,3,4,5,6-pentafluorophenyl)-1,3,5-triazine-2,4-diamine, and photosynthesis inhibitor diuron as negative control). The assay utilizes the somaclonal variation that is found in in vitro tissue culture. Spontaneous mutations derived from somaclonal variation can be enhanced by chemical mutagenesis (e.g. ethylmethane sulfonate; ethylethane sulfonate, N-nitroso-N-ethyl urea, ethylnitrosourea, nitrose acid, bromouracil, 2.-aminopurine, 5-fluorodeoxyuridine, hydroxylamine, N-methyl-N'-nitro-N-nitrosoguanidine) and subsequent selection in a stepwise manner, on increasing concentrations of herbicide.

The present invention provides tissue culture conditions for encouraging growth of friable, embryogenic maize or rice callus that is regenerable. Calli are initiated from 4 different maize or rice cultivars encompassing *Zea mays* and *Japonica* (Taipei 309, Nipponbare, Koshihikari) and Indica (Indica 1) varieties, respectively. Seeds are surface sterilized in 70% ethanol for approximately 1 min followed by 20% commercial Clorox bleach for 20 minutes. Seeds are rinsed with sterile water and plated on callus induction media. Various callus induction media are tested. The ingredient lists for the media tested are presented in Table E4-1.

TABLE E4-1

| Ingredient | Supplier | R001M | R025M | R026M | R327M | R008M | MS711R |
|---|---|---|---|---|---|---|---|
| B5 Vitamins | Sigma | | | | | 1.0 X | |
| MS salts | Sigma | | | 1.0 X | 1.0 X | 1.0 X | 1.0 X |
| MS Vitamins | Sigma | | | 1.0 X | 1.0 X | | |
| N6 salts | Phytotech | 4.0 g/L | 4.0 g/L | | | | |
| N6 vitamins | Phytotech | 1.0 X | 1.0 X | | | | |
| L-Proline | Sigma | 2.9 g/L | 0.5 g/L | | | | 1.2 g/L |
| Casamino Acids | BD | 0.3 g/L | 0.3 g/L | 2 g/L | | | |
| Casein Hydrolysate | Sigma | | | | | | 1.0 g/L |
| L-Asp Monohydrate | Phytotech | | | | | | 150 mg/L |
| Nicotinic Acid | Sigma | | | | | | 0.5 mg/L |
| Pyridoxine HCl | Sigma | | | | | | 0.5 mg/L |
| Thiamine HCl | Sigma | | | | | | 1.0 mg/L |
| Myo-inositol | Sigma | | | | | | 100 mg/L |
| MES | Sigma | 500 mg/L | 500 mg/L | 500 mg/L | 500 mg/L | 500 mg/L | 500 mg/L |

TABLE E4-1-continued

| Ingredient | Supplier | R001M | R025M | R026M | R327M | R008M | MS711R |
|---|---|---|---|---|---|---|---|
| Maltose | VWR | 30 g/L | 30 g/L | 30 g/L | 30 g/L | | |
| Sorbitol | Duchefa | | | 30 g/L | | | |
| Sucrose | VWR | | | | | 10 g/L | 30 g/L |
| NAA | Duchefa | | | | | 50 µg/L | |
| 2,4-D | Sigma | 2.0 mg/L | | | | | 1.0 mg/L |
| MgCl$_2$•6H$_2$O | VWR | | | | | 750 mg/L | |
| →pH | | 5.8 | 5.8 | 5.8 | 5.8 | 5.8 | 5.7 |
| Gelrite | Duchefa | 4.0 g/L | | | | 2.5 g/L | |
| Agarose Type1 | Sigma | | 7.0 g/L | 10 g/L | 10 g/L | | |
| →Autoclave | | 15 min | 15 min | 15 min | 15 min | 15 min | 20 min |
| Kinetin | Sigma | | 2.0 mg/L | 2.0 mg/L | | | |
| NAA | Duchefa | | 1.0 mg/L | 1.0 mg/L | | | |
| ABA | Sigma | | 5.0 mg/L | | | | |
| Cefotaxime | Duchefa | | 0.1 g/L | 0.1 g/L | 0.1 g/L | | |
| Vancomycin | Duchefa | | 0.1 g/L | 0.1 g/L | 0.1 g/L | | |
| G418 Disulfate | Sigma | | 20 mg/L | 20 mg/L | 20 mg/L | | |

R001M callus induction media was selected after testing numerous variations. Cultures were kept in the dark at 30° C. Embryogenic callus was subcultured to fresh media after 10-14 days.

Example 5: Selection of Azine-Herbicide-Tolerant Calli

Once tissue culture conditions were determined, further establishment of selection conditions are established through the analysis of tissue survival in kill curves with azine herbicides e. g. like 6-cyclopentyl-N4-(2,3,4,5,6-pentafluorophenyl)-1,3,5-triazine-2,4-diamine, and photosynthesis inhibitor diuron as negative control. Careful consideration of accumulation of the herbicide in the tissue, as well as its persistence and stability in the cells and the culture media are performed. Through these experiments, a sublethal dose is established for the initial selection of mutated material. After the establishment of the starting dose of azine herbicides like e. g. 6-cyclopentyl-N4-(2,3,4,5,6-pentafluorophenyl)-1,3,5-triazine-2,4-diamine, and photosynthesis inhibitor diuron as negative control in selection media, the tissues were selected in a step-wise fashion by increasing the concentration of the cellulose synthase inhibitor with each transfer until cells are recovered that grew vigorously in the presence of toxic doses. The resulting calli are further subcultured every 3-4 weeks to R001M with selective agent. Over 26,000 calli are subjected to selection for 4-5 subcultures until the selective pressure is above toxic levels as determined by kill curves and observations of continued culture. Alternatively, liquid cultures initiated from calli in MS711R with slow shaking and weekly subcultures. Once liquid cultures are established, selection agent is added directly to the flask at each subculture. Following 2-4 rounds of liquid selection, cultures are transferred to filters on solid R001M media for further growth.

Example 6: Regeneration of Plants

Tolerant tissue is regenerated and characterized molecularly for cellulose synthase gene sequences mutations. In addition, genes involved directly and/or indirectly in cell wall biosynthesis and/or metabolism pathways are also sequenced to characterize mutations. Finally, enzymes that change the fate (e.g. metabolism, translocation, transportation) are also sequenced to characterize mutations. Following herbicide selection, calli are regenerated using a media regime of R025M for 10-14 days, R026M for ca. 2 weeks, R327M until well formed shoots were developed, and R008S until shoots are well rooted for transfer to the greenhouse. Regeneration was carried out in the light. No selection agent is included during regeneration. Once strong roots are established, MO regenerants are transplant to the greenhouse in square or round pots. Transplants are maintained under a clear plastic cup until they were adapted to greenhouse conditions. The greenhouse was set to a day/night cycle of 27° C./21° C. (80° F./70° F.) with 600 W high pressure sodium lights supplementing light to maintain a 14 hour day length. Plants are watered according to need, depending in the weather and fertilized daily.

Example 7: Sequence Analysis

Leaf tissue is collected from clonal plants separated for transplanting and analyzed as individuals. Genomic DNA is extracted using a Wizard® 96 Magnetic DNA Plant System kit (Promega, U.S. Pat. Nos. 6,027,945 & 6,368,800) as directed by the manufacturer. Isolated DNA is PCR amplified using the appropriate forward and reverse primer.

PCR amplification is performed using Hotstar Taq DNA Polymerase (Qiagen) using touchdown thermocycling program as follows: 96° C. for 15 min, followed by 35 cycles (96° C., 30 sec; 58° C.-0.2° C. per cycle, 30 sec; 72° C., 3 min and 30 sec), 10 min at 72° C. PCR products were verified for concentration and fragment size via agarose gel electrophoresis. Dephosphorylated PCR products are analyzed by direct sequence using the PCR primers (DNA Landmarks). Chromatogram trace files (.scf) are analyzed for mutation relative to the wild-type gene using Vector NTI Advance 10™ (Invitrogen). Based on sequence information, mutations are identified in several individuals. Sequence analysis is performed on the representative chromatograms and corresponding AlignX alignment with default settings and edited to call secondary peaks.

Example 8: Soybean Transformation and Cellulose Biosynthesis Inhibitor Tolerance Testing Binary vectors are generated as described in Example 2. Soybean cv Jake are transformed as previously described by Siminszky et al., Phytochem Rev. 5:445-458 (2006). After regeneration, transformants are transplanted to soil in small pots, placed in growth chambers (16 hr day/8 hr night; 25° C. day/23° C. night; 65% relative humidity; 130-150 microE m-2 s-1) and subsequently tested for the presence of the T-DNA via Taqman analysis. After a few weeks, healthy, transgenic positive, single copy events are transplanted to larger pots and allowed to grow in the growth chamber. An optimal shoot for cutting is about 3-4 inches tall, with at least two nodes present. Each cutting is taken from the original transformant (mother plant) and dipped into rooting hormone powder (indole-3-butyric acid, IBA). The cutting is then placed in oasis wedges inside a bio-dome. The mother plant is taken to maturity in the greenhouse and harvested for seed. Wild type cuttings are also taken simultaneously to serve as negative controls. The cuttings are kept in the bio-dome for 5-7 days. 3-4 days after transfer to oasis wedges, the shoots are treated via nutrient solution with the herbicide. Typical phytotox symptoms, like club shaped root, are evaluated 3-4 days after treatment. Less or no injury of transgenic plants compared to wildtype plants are interpreted as herbicide tolerance.

Example 9: Engineering Cellulose Biosynthesis Inhibitor Tolerant Corn or Rice Plants Having Mutated Cellulose Synthase Sequences Immature embryos can be transformed according to the procedure outlined in Peng et al. (WO2006/136596). Plants are tested for the presence of the T-DNA by Taqman analysis with the target being the nos terminator which is present in all constructs. Healthy looking plants are sent to the greenhouse for hardening and subsequent spray testing. The plants are individually transplanted into MetroMix 360 soil in 4" pots. Once in the greenhouse (day/night cycle of 27° C./21° C. with 14 hour day length supported by 600 W high pressure sodium lights), they are allowed to grow for 14 days. Transformation of *Oryza sativa* (rice) are done by protoplast transformation as described by Peng et al. (U.S. Pat. No. 6,653,529). Transgenic corn and rice plants are cultivated to T1 seeds for herbicide tolerance testing.

Example 10: Demonstration of Herbicide Tolerance of Mutagenized Rice Lines

*Oryza sativa* M2 Volano is a cellulose biosynthesis inhibitor susceptible rice risotto population that was subjected to sodium azide seed mutagenesis but was not tilled nor selected for CESA mutations. *O. sativa* Volano-M3-CESA1 and CESA3 mutants were selected from a subpopulation of *O. sativa* M2 Volano by sequencing CESA gene sequences in M2 plants and maintaining (producing seed through selfing) those individuals containing key mutations in these genes. The tolerance of the M3 CESA1 and CESA3 mutants was assessed using 6-(1-fluorocyclopentyl)-N2-(2,3,5,6-tetrafluorophenyl)-1,3,5-triazine-2,4-diamine, together with 1.0% DASH® EC adjuvant (BASF). The tolerance of M4 CESA1 and CESA3 mutants was assessed using 6-cyclopentyl-N4-(2,3,4,5,6-pentafluorophenyl)-1,3,5-triazine-2,4-diamine, together with 1.0% DASH® EC adjuvant (BASF).

M3 seed, which were harvested from tilled and selected individuals containing mutations in the CESA1 and CESA3 genes, were grown in the greenhouse under natural light conditions supplemented with 400 W sodium halide lamps under a 16 hr day length. Day/night temperatures were 26 and 20° C., respectively. The number of M3 plants from each line varied between 2 and 16, depending on seed availability and germination. A non-selective CBI, azine 6-(1-fluorocyclopentyl)-N2-(2,3,5,6-tetrafluorophenyl)-1,3,5-triazine-2,4-diamine, formulated with 1.0% DASH in a water volume of 375 L/ha was applied early post-emergent (one to two leaf stage) at a rate of 250 g ai/ha to M3 CESA1 and CESA3 mutant rice plants growing in soil in the greenhouse. Only plants originating from lines having more than four seeds were subjected to herbicide treatment. CESA mutant lines with four or fewer seeds were selfed for an additional generation and then tested at the M4 generation with 6-cyclopentyl-N4-(2,3,4,5,6-pentafluorophenyl)-1,3,5-triazine-2,4-diamine. M4 plants were grown under similar conditions as M3 plants and treated with 250 g ai/ha or 500 g ai/ha of 6-cyclopentyl-N4-(2,3,4,5,6-pentafluorophenyl)-1,3,5-triazine-2,4-diamine. Previous kill curve greenhouse tests had identified that a rate of 250 g ai/ha of 6-(1-fluorocyclopentyl)-N2-(2,3,5,6-tetrafluorophenyl)-1,3,5-triazine-2,4-diamine and a rate of 250 g ai/ha 6-cyclopentyl-N4-(2,3,4,5,6-pentafluorophenyl)-1,3,5-triazine-2,4-diamine, both with 1.0% DASH, were sufficient doses to kill *O. sativa* M2 Volano check plants. The plants were subjected to an evenly applied herbicide application in a greenhouse spray cabinet equipped with TeeJet@ Extended Range spray nozzles (XR110015-V). Plants were assessed for crop injury, using a scale from 0% injury to 100% injury, at 11 and 21 days after treatment (DAT) for M3 plants applied with 6-(1-fluorocyclopentyl)-N2-(2,3,5,6-tetrafluorophenyl)-1,3,5-triazine-2,4-diamine and 36 DAT for M4 plants applied with 6-cyclopentyl-N4-(2,3,4,5,6-pentafluorophenyl)-1,3,5-triazine-2,4-diamine. Plants without any symptoms were recorded as "0%" injury. Increasing levels of reduced leaf mass and reduced stalk stiffness, with respect to the untreated control plants, were recorded in the range of "1 to 49%" injury. Increasing levels of leaf abnormalities and leaf necrosis, along with increased levels of lodging, relative to the untreated control plants, were recorded in the range of "50 to 85%" injury. Dead or dying plants with necrosis of the apex and severe lodging were recorded between "86-100%". Data on individual plants was assessed and recorded due to the low number of individuals per line and the fact that the CESA mutations in the M2 generation were heterozygous and therefore segregating at the M3 and M4 generations. The presence and zygosity of the CESA mutations were confirmed in surviving M3 and M4 plants by DNA sequencing.

Table E10-1.—Crop injury on tilled Rice M3 generation cellulose synthase mutants and wild type materials after foliar application of 250 g ai/ha of 6-(1-fluorocyclopentyl)-N2-(2,3,5,6-tetrafluorophenyl)-1,3,5-triazine-2,4-diamine, herbicide at 20 days after treatment (DAT).

| SEQ ID | Gene | Mutation / Variant | Zygosity of Mutation in Parental Plant | Crop Injury Assessment (%) at 20 DAT |
|---|---|---|---|---|
| — | OsCESA | ▲WT | — | 100% |
| — | OsCESA | WT | — | 100% |
| — | OsCESA | WT | — | 100% |
| — | OsCESA | WT | — | 100% |
| 51 | OsCESA1 | A1066T | ▲Het | 10% |
| 51 | OsCESA1 | S827N | Het | 0% |
| 51 | OsCESA1 | V9231 | Het | 0% |
| 51 | OsCESA1 | V9231 | Het | 0% |
| 51 | OsCESA1 | V9231 | Het | 0% |
| 55 | OsCESA3 | V1022L | ▲Hom | 20% |

▲WT = wild type (no polymorphism in native gene)
Het = heterozygous for the mutation as confirmed by DNA sequencing
Hom = homozygous for the mutation as confirmed by DNA sequencing

TABLE E10-2

Crop injury on tilled Rice M4 generation cellulose synthase mutants and wild type materials after foliar application of 250 g ai/ha or 500 g ai/ha of 6-cyclopentyl-N4-(2,3,4,5,6-pentafluorophenyl)-1,3,5-triazine-2,4-diamine, herbicide at 23 and 36 days after treatment (DAT).

| SEQ ID | Gene | Mutation | Zygosity of mutation in parental plant | Rate of herbicide selection [g ai/ha] | Crop injury assessment (%) at 23 DAT | Crop injury assessment (%) at 36 DAT |
|---|---|---|---|---|---|---|
| — | OsCESA | *WT | — | 250 | 75% | 70% |
| — | OsCESA | WT | — | 250 | 65% | 95% |
| — | OsCESA | WT | — | 500 | 98% | 100% |
| — | OsCESA | WT | — | 500 | 95% | 100% |
| 51 | OsCesA1 | T952I | *Het | 250 | 0% | 0% |
| 51 | OsCesA1 | T952I | Het | 250 | 0% | 15% |
| 51 | OsCesA1 | T952I | Het | 250 | 0% | 35% |
| 51 | OsCesA1 | T952I | Het | 500 | 10% | 10% |
| 51 | OsCesA1 | A1066T | Het | 250 | 0% | 10% |
| 51 | OsCesA1 | A1066T | Het | 250 | 35% | 25% |
| 51 | OsCesA1 | S827N | Hom | 250 | 0% | 0% |

*WT = wild type (no polymorphism in native gene)
Het = heterozygous for the mutation as confirmed by DNA sequencing
Hom = homozygous for the mutation as confirmed by DNA sequencing Example 11: Demonstration of Herbicide Tolerance T0 or T1 transgenic plant of soybean, corn, rice, sunflower and *Brassica napus* containing cellulose synthase sequences or mutated gene variants thereof are tested for improved tolerance to herbicides in greenhouse studies and mini-plot studies with azine herbicides. For the pre-emergence treatment, the herbicides are applied directly after sowing by means of finely distributing nozzles. The containers are irrigated gently to promote germination and growth and subsequently covered with transparent plastic hoods until the plants have rooted. This cover causes uniform germination of the test plants, unless this has been impaired by the herbicides. For post emergence treatment, the test plants are first grown to a height of 3 to 15 cm, depending on the plant habit, and only then treated with the herbicides. For this purpose, the test plants are either, sown directly and grown in the same containers or they are first grown separately and transplanted into the test containers a few days prior to treatment.

Herbicide injury evaluations are taken at 2 and 3 weeks after treatment. Plant injury is rated on a scale of 0% to 100%, 0% being no injury and 100% being complete death.

SEQUENCE LISTING (285 sequences)

SEQ ID NO: 1 - protein, 1081 aa, Arabidopsis thaliana
MEASAGLVAGSYRRNELVRIRHESDGGTKPLKNMNGQICQICGDDVGLAETGDVFVACNECAFPVCRPCYEYERKDGTQCCPQCKTRFRRHRGSPRVEGDEDEDDVDDIENEFNYAQGANKARHQRHGEEFSSSSRHESQPIPLLTHGHTVSGEIRTPDTQSVRTTSGPLGPSDRNAISSPYIDPRQPVPVRIVDPSKDLNSYGLGNVDWKERVEGWKLKQEKNMLQMTGKYHEGKGGEIEGTGSNGEELQMADDTRLPMSRVVPIPSSRLTPYRVVIILRLIILCFFLQYRTTHPVKNAYPLWLTSVICEIWFAFSWLLDQFPKWYPINRETYLDRLAIRYDRDGEPSQLVPVDVFVSTVDPLKEPPLVTANTVLSILSVDYPVDKVACYVSDDGSAMLTFESLSETAEFAKKWVPFCKKFNIEPRAPEFYFAQKIDYLKDKIQPSFVKERRAMKREYEEFKVRINALVAKAQKIPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNIVFFDINMKGLDGIQGPVYVGTGCCFNRQALYGYDPVLTEEDLEPNIIVKSCCGSRKKGKSSKKYNYEKRRGINRSDSNAPLFNMEDIDEGFEGYDDERSILMSQRSVEKRFGQSPVFIAATFMEQGGIPPTTNPATLLKEAIHVISCGYEDKTEWGKEIGWIYGSVTEDILTGFKMHARGWISIYCNPPRPAFKGSAPINLSDRLNQVLRWALGSIEILLSRHCPIWYGYHGRLRLLERIAYINTIVYPITSIPLIAYCILPAFCLITDRFIIPEISNYASIWFILLFISIAVTGILELRWSGVSIEDWWRNEQFWVIGGTSAHLFAVFQGLLKVLAGIDTNFTVTSKATDEDGDFAELYIFKWTALLIPPTTVLLVNLIGIVAGVSYAVNSGYQSWGPLFGKLFFALWVIAHLYPFLKGLLGRQNRTPTIVIVWSVLLASIFSLLWVRINPFVDANPNANNFNGKGGVF

SEQ ID NO: 2 - protein, 1084 aa, Arabidopsis thaliana
MNTGGRLIAGSHNRNEFVLINADESARIRSVQELSGQTCQICGDEIELTVSSELFVACNECAFPVCRPCYEYERREGNQACPQCKTRYKRIKGSPRVDGDDEEEEDIDDLEYEFDHGMDPEHAAEAALSSRLNTGRGGLDSAPPGSQIPLLTYCDEDADMYSDRHALIVPPSTGYGNRVYPAPFTDSSAPPQARSMVPQKDIAEYGYGSVAWKDRMEVWKRRQGEKLQVIKHEGGNNGRGSNDDDELDDPDMPMMDEGRQPLSRKLPIRSSRINPYRMLILCRLAILGLFFHYRILHPVNDAYGLWLTSVICEIWFAVSWILDQFPKWYPIERETYLDRLSLRYEKEGKPSGLAPVDVFVSTVDPLKEPPLITANTVLSILAVDYPVDKVACYVSDDGAAMLTFEALSDTAEFARKWVPFCKKFNIEPRAPEWYFSQKMDYLKNKVHPAFVRERRAMKRDYEEFKVKINALVATAQKVPEEGWTMQDGTPWPGNNVRDHPGMIQVFLGHSGVRDTDGNELPRLVYVSREKRPGFDHHKKAGAMNSLIRVSAVLSNAPYLLNVDCDHYINNSKAIRESMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGN

SEQ ID NO: 3 - protein, 1065 aa, Arabidopsis thaliana
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVSDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLPAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 4 - protein, 1049 aa, Arabidopsis thaliana
MEPNTMASFDDEHRHSSFSAKICKVCGDEVKDDDNGQTFVACHVCVYPVCKPCYEYERSNGNKCCPQCNTLYKRHKGSPKIAGDEENNGPDDSDDELNIKYRQDGSSIHQNFAYGSENGDYNSKQQWRPNGRAFSSTGSVLGKDFEAERDGYTDAEWKERVDKWKARQEKRGLVTKGEQTNEDKEDDEEEYLDAEARQPLWRKVPISSSKISPYRIVIVLRLVILVFFFRFRILTPAKDAYPLWLISVICEIWFALSWILDQFPKWFPINRETYLDRLSMRFERDGEKNKLAPVDVFVSTVDPLKEPPIITANTILSILAVDYPVNKVSCYVSDDGASMLLFDTLSETSEFARRWVPFCKKYNVEPRAPEFYFSEKIDYLKDKVQTTFVKDRRAMKREYEEFKVRINALVAKAQKKPEEGWVMQDGTPWPGNNTRDHPGMIQVYLGKEGAFDIDGNELPRLVYVSREKRPGYAHHKKAGAMNAMVRVSAVLTNAPFMLNLDCDHYINNSKAIRESMCFLMDPQLGKKLCYVQFPQRFDGIDLNDRYANRNIVFFDINMRGLDGIQGPVYVGTGCVFNRPALYGYEPPVSEKRKKMTCDCWPSWICCCCGGGNRNHKSDSSKKKSGIKSLFSKLKKKTKKKSDDKTMSSYSRKRSSTEAIFDLEDIEEGLEGYDELEKSSLMSQKNFEKRFGMSPVFIASTLMENGGLPEATNTSSLIKEAIHVISCGYEEKTEWGKEIGWIYGSVTEDILTGFRMHCRGWKSVYCMPKRPAFKGSAPINLSDRLHQVLRWALGSVEIFFSRHCPLWYAWGGKLKILERLAYINTIVYPFTSIPLLAYCTIPAVCLLTGKFIIPTINNFASIWFLALFLSIIATAILELRWSGVSINDLWRNEQFWVIGGVSAHLFAVFQGLLKVLFGVDTNFTVTSKGASDEADEFGDLYLFKWTTLLIPPTTLIILNMVGVVAGVSDAINNGYGSWGPLFGKLFFAFWVIVHLYPFLKGLMGRQNRTPTIVVLWSILLASIFSLVWVRIDPFLPKQTGPLLKQCGVDC

SEQ ID NO: 5 - protein, 1069 aa, Arabidopsis thaliana
MNTGGRLIAGSHNRNEFVLINADESARIRSVEELSGQTCQICGDEIELSVDGESFVACNECAFPVCRPCYEYERREGNQSCPQCKTRYKRIKGSPRVEGDEEDDGIDDLDFEFDYSRSGLESETFSRRNSEFDLASAPPGSQIPLLTYGEEDVEISSDSHALIVSPSPGHIHRVHQPHFPDPAAHPRPMVPQKDLAVYGYGSVAWKDRMEEWKRKQNEKYQVVKHDGDSSLGDGDDADIPMMDEGRQPLSRKVPIKSSKINPYRMLIVLRLVILGLFFHYRILHPVNDAYALWLISVICEIWFAVSWVLDQFPKWYPIERETYLDRLSLRYEKEGKPSELAGVDVFVSTVDPMKEPPLITANTVLSILAVDYPVDRVACYVSDDGAAMLTFEALSETAEFARKWVPFCKKYTIEPRAPEWYFCHKMDYLKNKVHPAFVRERRAMKRDYEEFKVKINALVATAQKVPEEGWTMQDGTPWPGNNVRDHPGMIQVFLGNNGVRDVENNELPRLVYVSREKRPGFDHHKKAGAMNSLIRVSGVLSNAPYLLNVDCDHYINNSKALREAMCFMMDPQSGKKICYVQFPQRFDGIDKSDRYSNRNVVFFDINMKGLDGLQGPIYVGTGCVFRRQALYGFDAPKKKKTKRMTCNCWPKWCLFCCGLRKNRKSKTTDKKKKNREASKQIHALENIEEGTKGTNDAAKSPEAAQLKLEKKFGQSPVFVASAGMENGGLARNASPASLLREAIQVISCGYEDKTEWGKEIGWIYGSVTEDILTGFKMHSHGWRSVYCTPKIPAFKGSAPINLSDRLHQVLRWALGSVEIFLSRHCPIWYGYGGGLKWLERLSYINSVVYPWTSIPLLVYCSLPAICLLTGKFIVPEISNYASILFMALFGSIAVTGILEMQWGKVGIDDWWRNEQFWVIGGVSAHLFALFQGLLKVLAGVETNFTVTSKAADDGEFSELYIFKWTSLLIPPTTLLIINVIGVIVGISDAISNGYDSWGPLFGRLFFAFWVILHLYPFLKGLLGKQDRMPTIILVWSILLASILTLLWVRVNPFVAKGGPILEICGLDCL

SEQ ID NO: 6 - protein, 1084 aa, Arabidopsis thaliana
MNTGGRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRHEGDPDFEDGDDADFPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCL

SEQ ID NO: 7 - protein, 1026 aa, Arabidopsis thaliana
MEASAGLVAGSHNRNELVVIHNHEEPKPLKNLDGQFCEICGDQIGLTVEGDLFVACNECGFPACRPCYEYERREGTQNCPQCKTRYKRLRGSPRVEGDEDEEDIDDIEYEFNIEHEQDKHKHSAEAMLYGKMSYGRGPEDDENGRFPPVIAGGHSGEFPVGGGYGNGEHGLHKRVHPYPSSEAGSEGGWRERMDDWKLQHGNLGPEPDDDPEMGLIDEARQPLSRKVPIASSKINPYRMVIVARLVILAVFLRYRLLNPVHDALGLWLTSVICEIWFAVSWILDQFPKWFPIERETYLDRLSLRYEREGEPNMLAPVDVFVSTVDPLKEPPLVTSNTVLSILAMDYPVEKISCYVSDDGASMLTFESLSETAEFARKWVPFCKKFSIEPRAPEMYFTLKVDYLQDKVHPTFVKERRAMKREYEEFKVRINAQVAKASKVPLEGWIMQDGTPWPGNNTKDHPGMIQVFLGHSGGFDVEGHELPRLVYVSREKRPGFQHHKKAGAMNALVRVAGVLTNAPFMLNLDCDHYVNNSKAVREAMCFLMDPQIGKKVCYVQFPQRFDGIDTNDRYANRNTVFFDINMKGLDGIQGPVYVGTGCVFKRQALYGYEPPKGPKRPKMISCGCCPCFGRRRKNKKFSKNDMNGDVAALGGAEGDKEHLMSEMNFEKTFGQSSIFVTSTLMEEGGVPPSSSPAVLLKEAIHVISCGYEDKTEWGTELGWIYGSITEDILTGFKMHCRGWRSIYCMPKRPAFKGSAPINLSDRLNQVLRWALGSVEIFFSRHSPLWYGYKGGKLKWLERFAYANTTIYPFTSIPLLAYCILPAICLLTDKFIMPPISTFASLFFISLFMSIIVTGILELRWSGVSIEEWWRNEQFWVIGGISAHLFAVVQGLLKILAGIDTNFTVTSKATDDDDFGELYAFKWTTLLIPPTTVLIINIVGVVAGISDAINNGYQSWGPLFGKLFFSFWVIVHLYPFLKGLMGRQNRTPTIVVIWSVLLASIFSLLWVRIDPFVLKTKGPDTSKCGINC

SEQ ID NO: 8 - protein, 985 aa, Arabidopsis thaliana
MMESRSPICNTCGEEIGVKSNGEFFVACHECSFPICKACLEYEFKEGRRICLRCGNPYDENVFDDVETKTSKTQSIVPTQTNNTSQDSGIHARHISTVSTIDSELNDEYGNPIWKNRVESWKDKKDKKSKKKKKDPKATKAEQHEAQIPTQQHMEDTPPNTESGATDVLSVVIPIPRTKITSYRIVIIMRLIILALFFNYRITHPVDSAYGLWLTSVICEIWFAVSWVLDQFPKWSPINRETYIDRLSARFEREGEQSQLAAVDFFVSTVDPLKEPPLITANTVLSILALDYPVDKVSCYVSDDGAAMLSFESLVETADFARKWVPFCKKYSIEPRAPEFYFSLKIDYLRDKVQPSFVKERRAMKRDYEEFKIRMNALVAKAQKTPEEGWTMQDGTSWPGNNTRDHPGMIQVFLGYSGARDIEGNELPRLVYVSREKRPGYQHHKKAGAENALVRVSAVLTNAPFILNLDCDHYVNNSKAVREAMCFLMDPVVGQDVCFVQFPQRFDGIDKSDRYANRNIVFFDVNMRGLDGIQGPVYVGTGTVFRRQALYGYSPPSKPRILPQSSSSSCCCLTKKKQPQDPSEIYKDAKREELDAAIFNLGDLDNYDEYDRSMLISQTSFEKTFGLSTVFIESTLMENGGVPDSVNPSTLIKEAIHVISCGYEEKTEWGKEIGWIYGSITEDILTGFKMHCRGWRSIYCMPLRPAFKGSAPINLSDRLHQVLRWALGSVEIFLSRHCPLWYGCSGGRLKLLQRLAYINTIVYPFTSLPLVAYCTLPAICLLTGKFIIPTLSNLASMLFLGLFISIILTSVLELRWSGVSIEDLWRNEQFWVIGGVSAHLFAVFQGFLKMLAGLDTNFTVTSKTADDLEFGELYIVKWTTLLIPPTSLLIINLVGVVAGFSDALNKGYEAWGPLFGKVFFAFWVILHLYPFLKGLMGRQNRTPTIVILWSILLASVFSLVWVRINPFVSKTDTTSLSLNCLLIDC

SEQ ID NO: 9 - protein, 1088 aa, Arabidopsis thaliana
MNTGGRLIAGSHNRNEFVLINADDTARIRSAEELSGQTCKICRDEIELTDNGEPFIACNECAFPTCRPCYEYERREGNQACPQCGTRYKRIKGSPRVEGDEEDDDIDDLEHEFYGMDPEHVTEAALYYMRLNTGRGTDEVSHLYSASPGSEVPLLTYCDEDSDMYSDRHALIVPPSTGLGNRVHHVPFTDSFASIHTRPMVPQKDLTVYGYGSVAWKDRMEVWKKQQIEKLQVVKNERVNDGDGDGFIVDELDDPGLPMMDEGRQPLSRKLPIRSSRINPYRMLIFCRLAILGLFFHYRILHPVNDAFGLWLTSVICEIWFAVSWILDQFPKWYPIERETYLDRLSLRYEKEGKPSELAPVDVFVSTVDPLKEPPLITANTVLSILAVDYPVEKVACYVSDDGAAMLTFEALSYTAEFARKWVPFCKKFSIEPRAPEWYFSQKMDYLKHKVDPAFVMERRAMKRDYEEFKVKINALVSVSQKVPEDGWTMQDGTPWPGNNVRDHPGMIQVFLGHSGVCDMDGNELPRLVYVSREKRPGFDHHKKAGAMNSLIRVSAVLSNAPYLLNVDCDHYINNSKAIREAMCFMMDPQSGKKICYVQFPQRFDGIDRHDRYSNRNVVFFDINMKGLDGIQGPIYVGTGCVFRRQALYGFDAPKKKQPPGRTCNCWPKWCCLCCGMRKKKTGKVKDNQRKKPKETSKQIHALEHIEEGLQVTNAENNSETAQLKLEKKFGQSPVLVASTLLLNGGVPSNVNPASLLRESIQVISCGYEEKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLLVYCSLPAICLLTGKFIVPEISNYAGILFLLMFMSIAVTGILEMQWGKIGIDDWWRNEQFWVIGGVSSHLFALFQGLLKVLAGVSTNFTVTSKAADDGEFSELYIFKWTSLLIPPTTLLIINIVGVIVGVSDAINNGYDSWGPLFGRLFFALWVIVHLYPFLKGLLGKQDRVPTIILVWSILLASILTLLWVRVNPFVSKDGPVLEICGLDCLK

SEQ ID NO: 10 - protein, 1065 aa, Arabidopsis thaliana
MVAGSYRRYEFVRNRDDSDDGLKPLKDLNGQICQICGDDVGLTKTGNVFVACNECGFPLCQSCYEYERKDGSQCCPQCKARFRRHNGSPRVEVDEKEDDVNDIENEFDYTQGNNKARLPHRAEEFSSSSRHEESLPVSLLTHGHPVSGEIPTPDRNATLSPCIDPQLPGIYQLLLLPVRILDPSKDLNSYGLVNVDWKKRIQGWKLKQDKNMIHMTGKYHEGKGGEFEGTGSNGDELQMVDDARLPMSRVVHFPSARMTPYRIVIVLRLIILGVFLHYRTTHPVKDAYALWLTSVICEIWFAFSWLLDQFPKWYPINRETFLDRLALRYDRDGEPSQLAPVDVFVSTVDPMKEPPLVTANTVLSILAVDYPVDKVACYVSDDGSAMLTFEALSETAEFSKKWVPFCKKFNIEPRAPEFYFSQKIDYLKDKIQPSFVKERRAMKREYEEFKVRINILVAKAQKIPEDGWTMEDGTSWPGNNPRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNTVFFDINLKGLDGIQGPVYVGTGCCFNRQALYGYDPVLTEEDLEPNIIVKSCFGSRKKGKSRKIPNYEDNRSIKRSDSNVPLFNMEDIDEDVEGYEDEMSLLVSQKRLEKRFGQSPVFIAATFMEQGGLPSTTNPLTLLKEAIHVISCGYEAKTDWGKEIGWIYGSVTEDILTGFKMHARGWISIYCVPSRPAFKGSAPINLSDRLNQVLRWALGSIEILLSRHCPIWYGYNGRLKLLERIAYINTIVYPITSIPLLAYCMLPAFCLITNTFIIPEISNLASLCFMLLFASIYASAILELKWSDVALEDWWRNEQFWVIGGTSAHLFAVFQGLLKVFAGIDTNFTVTSKASDEDGDFAELYVFKWTSLLIPPTTILLVNLVGIVAGVSYAINSGYQSWGPLMGKLLFAFWVVAHLYPFLKGLLGRQNRTPTIVIVWSALLASIFSLLWVRINPFVSTTGVMSNSFMGE

SEQ ID NO: 11 - protein, 1074 aa, Zea mays
MAANKGMVAGSHNRNEFVMIRHDGDAPVPAKPTKSANGQVCQICGDTVGVSATGDVFVACNECAFPVCRPCYEYERKEGNQCCPQCKTRYKRQKGSPRVHGDDEEEDVDDLDNEFNYKQGNGKGPEWQLQGDDADLSSSARHDPHHRIPRLTSGQQISGEIPDASPDRHSIRSPTSSYVDPSVPVPVRIVDPSKDLNSYGLNSVDWKERVESWRVKQDKNMLQVTNKYPEARGDMEGTGSNGEDMQMVDDARLPLSRIVPISSNQLNLYRIVIILRLIILCFFFQYRISHPVRNAYGLWLVSVICEVWFALSWLLDQFPKWYPINRETYLDRLALRYDREGEPSQLAPIDVFVSTVDPLKEPPLITANTVLSILAVDYPVDKVSCYVSDDGSAMLTFESLSETAEFARKWVPFCKKHNIEPRAPEFYFAQKIDYLKDKIQPSFVKERRAMKREYEEFKIRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVVKSCCGRRKRKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSVPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 12 - protein, 983 aa, Zea mays
MMESAAAQSCAACGDDARAACRACSYALCRACLDEDAAEGRTTCARCGGDYAAINPARASEGTEAEEEVVENHHTAGGLRERVTMGSHLNDRQDEVSHARTMSSLSGIGSELNDESGKPIWKNRVESWKEKKNEKKASAKKTAAKAQPPPVEEQIMDEKDLTDAYEPLSRVIPISKNKLTPYRAVIIMRLIVLGLFFHYRITNPVNSAFGLWMTSVICEIWFGFSWILDQFPKWYPINRETYVDRLIARYGDGEESGLAPVDFFVSTVDPLKEPPLITANTVLSILAVDYPVEKISCYVSDDGSAMLTFESLAETAEYARKWVPFCKKYAIEPRAPEFYFSQKIDYLKDKIHPSFVKERRAMKRDYEEYKVRINALVAKAQKTPDEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGLQGPVYVGTGCCFNRQALYGYGPPSLPALPKSSICSWCCCCCPKKKVERSEREINRDSRREDLESAIFNLREIDNYDEYERSMLISQMSFEKSFGLSSVFIESTLMENGGVPESANPSTLIKEAIHVISCGYEEKTEWGKEIGWIYGSVTEDILTGFKMHCRGWRSIYCMPVRPAFKGSAPINLSDRLHQVLRWALGSVEIFFSRHCPLWYGYGGGRLKWLQRLSYINTIVYPFTSLPLVAYCCLPAICLLTGKFIIPTLSNAATIWFLGLFMSIIVTSVLELRWSGIGIEDWWRNEQFWVIGGVSAHLFAVFQGILKMIAGLDTNFTVTAKATDDTEFGELYLFKWTTVLIPPTSILVLNLVGVVAGFSAALNSGYESWGPLFGKVFFAMWVIMHLYPFLKGLMGRQNRTPTIVVLWSVLLASVFSLLWVKIDPFVGGTETVNTNNCNTIIC

SEQ ID NO: 13 - protein, 1074 aa, Zea mays
MEANRGMVAGSRGGVVTIRHDGDGAAAKQLKNVNEQICQICGDTLGLSATGDIFVACNECAFPVCRPCYEYERKEGNQCCPQCKTRYKRHKGSPRVRGDEEEDGVDDLDNEFNYTQGNVQGPQWQLRGQGEDVDISSSSRHEPHHRIPRLTTGQQMSGDIPDASPDRHSIRSPTPSYVDPSIPVPVRIVDPSKDLNSYGVGSVDWKERVESWKVRQDKNMIQVTHKYPAEGKGDIEGTGSNGEDLQMADDARLPLSRIVPISPNELNLYRIVIVLRLIILCFFFQYRITHPVEDAYGLWLVSVICEVWFALSWLLDQFPKWYPINRETYLDRLALRYDREGEPSQLAPIDVFVSTVDPLKEPPLITGNTVLSILAVDYPVDKVSCYVSDDGSAMLTFEALSETAEFARKWVPFCKKHNIEPRAPEFYFAQKIDYLKDKIQPSFVKERRAMKREYEEFKVRINALVAKAQKIPEEGWTMADGTPWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIIIKSCCGGRKKKDKSYIDSKNRDMKRTESSAPIFNMEDIEEGFEGYEDERSLLMSQKSLEKRFGQSPIFIASTFMTQGGIPPSTNPGSLLKEAIHVISCGYEDKTEWGKEIGWIYGSVTEDILTGFKMHARGWISIYCMPLRPCFKGSAPINLSDRLNQVLRWALGSVEILLSRHCPIWYGYNGRLKLLERLAYINTIVYPITSIPLVAYCVLPAICLLTNKFIIPAISNYAGAFFILLFASIFATGILELRWSGVGIEDWWRNEQFWVIGGTSAHLFAVFQGLLKVLAGIDTNFTVTSKATDDDGDFAELYVFKWTTLLIPPTTVLVINLVGIVAGVSYAINSGYQSWGPLFGKLFFAIWVILHLYPFLKGLMGKQNRTPTIVIVWSVLLASIFSLLWVKIDPFISPTQKALSRGQCGVNC

SEQ ID NO: 14 - protein, 1086 aa, Zea mays
MEASAGLVAGSHNRNELVVIRRDGDPGPKPPREQNGQVCQICGDDVGLAPGGDPFVACNECAFPVCRDCYEYERREGTQNCPQCKTRYKRLKGCQRVTGDEEEDGVDDLDNEFNWDGHDSQSVAESMLYGHMSYGRGGDPNGAPQAFQLNPNVPLLTNGQMVDDIPPEQHALVPSFMGGGGKRIHPLPYADPSLPVQPRSMDPSKDLAAYGYGSVAWKERMENWKQRQERMHQTGNDGGGDDGDDADLPLMDEARQQLSRKIPLPSSQINPYRMIIIIRLVVLGFFFHYRVMHPVNDAFALWLISVICEIWFAMSWILDQFPKWFPIERETYLDRLSLRFDKEGQPSQLAPIDFFVSTVDPLKEPPLVTTNTVLSILSVDYPVDKVSCYVSDDGAAMLTFEALSETSEFAKKWVPFCKRYNIEPRAPEWYFQQKIDYLKDKVAANFVRERRAMKREYEEFKVRINALVAKAQKVPEEGWTMQDGTPWPGNNVRDHPGMIQVFLGQSGGLDCEGNELPRLVYVSREKRPGYNHHKKAGAMNALVRVSAVLTNAPYLLNLDCDHYINNSKAIKEAMCFMMDPLLGKKVCYVQFPQRFDGIDRHDRYANRNVVFFDINMKGLDGIQGPIYVGTGCVFRRQALYGYDAPKTKKPPSRTCNCWPKWCFCCCCFGNRKQKKTTKPKTEKKKLLFFKKEENQSPAYALGEIDEAAPGAENEKAGIVNQQKLEKKFGQSSVFVTSTLLENGGTLKSASPASLLKEAIHVISCGYEDKTDWGKEIGWIYGSVTEDILTGFKMHCHGWRSIYCIPKRVAFKGSAPLNLSDRLHQVLRWALGSIEIFFSNHCPLWYGYGGGLKFLERFSYINSIVYPWTSIPLLAYCTLPAICLLTGKFITPELNNVASLWFMSLFICIFATSILEMRWSGVGIDDWWRNEQFWVIGGVSSHLFAVFQGLLKVIAGVDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKDDGPLLEECGLDCN

SEQ ID NO: 15 - protein, 1056 aa, Zea mays
MEASAGLVAGSHNRNELVLIRGHEDPKPLRALSGQVCEICGDEVGLTVDGDLFVACNECGFPVCRPCYEYERREGTQNCPQCKTRYKRLKGTPRVAGDDDEEDIDDLEHEFNIDDENQQRQLEGNMQNSQITEAMLHGRMSYGRGPDDGDGNNTPQIPPIITGSRSVPVSGEFPITNGYGHGEVSSSLHKRIHPYPVSEPGSAKWDEKKEVSWKERMDDWKSKQGILGGGADPEDMDADVALNDEARQPLSRKVSIASSKVNPYRMVIVVRLVVLAFFLRYRILHPVPDAIGLWLVSIICEIWFAISWILDQFPKWFPIDRETSLSGLDDAARCRYEREGEPSLLSAVDLFVSTVDPLKEPPLVTANTVLSILAVDYPVDKVSCYVSDDGASMLTFESLSETAEFARKWVPFCKKFGIEPRAPEFYFSLKVDYLKDKVQPTFVQERRAMKREYEEFKVRINALVAKAMKVPAEGWIMKDGTPWPGNNTRDHPGMIQVFLGHSGGHDTEGNELPRLVYVSREKRPGFQHHKKAGAMNALIRVSAVLTNAPFMLNLDCDHYINNSKAIREAMCFLMDPQVGRKVCYVQFPQRFDGIDVHDRYANRNTVFFDINMKGLDGIQGPVYVGTGCVFRRQALYGYNPPKGPKRPKMVTCDCCPCFGRKKRKHAKDGLPEGTADMGVDSDKEMLMSHMNFEKRFGQSAAFVTSTLMEEGGVPPSSSPAALLKEAIHVISCGYEDKTDWGLELGWIYGSITEDILTGFKMHCRGWRSVYCMPKRAAFKGSAPINLSDRLNQVLRWALGSVEIFFSRHSPLLYGYKNGNLKWLERFAYINTTIYPFTSLPLLAYCTLPAVCLLTGKFIMPSISTFASLFFIALFMSIFATGILEMRWSGVSIEEWWRNEQFWVIGGVSAHLFAVVQGLLKVLAGIDTNFTVTSKATGDEDDEFAELYAFKWTTLLIPPTTLLIINVIGVVAGISDAINNGYQSWGPLFGKLFFAFWVIVHLYPFLKGLMGRQNRTPTVVVIWSILLASIFSLLWVRIDPFIVRTKGPDVRQCGINC

SEQ ID NO: 16 - protein, 1077 aa, Zea mays
MEGDADGVKSGRRGGGQVCQICGDGVGTTAEGDVFAACDVCGFPVCRPCYEYERKDGTQACPQCKTKYKRHKGSPAIRGEEGDDTDADSDFNYPASGNEDQKQKIADRMRSWRMNAGGSGDVGRPKYDSGEIGLTKYDSGEIPRGYIPSVTNSQISGEIPGASPDHHMMSPTGNIGKRAPFPYVNHSPNPSREFSGSIGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRVNGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKASKSKKGSDKKKSQKHVDSSVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSIPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 17 - protein, 1094 aa, Zea mays
MEASAGLVAGSHNRNELVVIRRDRESGAAGGGAARRAEAPCQICGDEVGVGFDGEPFVACNECAFPVCRACYEYERREGSQACPQCRTRYKRLKGCPRVAGDEEEDGVDDLEGEFGLQDGAAHEDDPQYVAESMLRAQMSYGRGGDAHPGFSPVPNVPLLTNGQMVDDIPPEQHALVPSYMSGGGGGGKRIHPLPFADPNLPVQPRSMDPSKDLAAYGYGSVAWKERMEGWKQKQERLQHVRSEGGGDWDGDDADLPLMDEARQPLSRKVPISSSRINPYRMIIVIRLVVLGFFFHYRVMHPAKDAFALWLISVICEIWFAMSWILDQFPKWLPIERETYLDRLSLRFDKEGQPSQLAPIDFFVSTVDPTKEPPLVTANTVLSILSVDYPVEKVSCYVSDDGAAMLTFEALSETSEFAKKWVPFSKKFNIEPRAPEWYFQQKIDYLKDKVAASFVRERRAMKREYEEFKVRINALVAKAQKVPEEGWTMQDGSPWPGNNVRDHPGMIQVFLGQSGGRDVEGNELPRLVYVSREKRPGYNHHKKAGAMNALVRVSAVLSNAAYLLNLDCDHYINNSKAIKEAMCFMMDPLVGKKVCYVQFPQRFDGIDKNDRYANRNVVFFDINMKGLDGIQGPIYVGTGCVFRRQALYGYDAPKTKKPPSRTCNCWPKWCLSCCCSRNKNKKKTTKPKTEKKKRLFFKKAENPSPAYALGEIDEGAPGADIEKAGIVNQQKLEKKFGQSSVFVASTLLENGGTLKSASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICLLTGKFITPELTNVASIWFMALFICISVTGILEMRWSGVAIDDWWRNEQFWVIGGVSAHLFAVFQGLLKVFAGIDTSFTVTSKAGDDEEFSELYTFKWTTLLIPPTTLLLLNFIGVVAGISNAINNGYESWGPLFGKLFFAFWVIVHLYPFLKGLVGRQNRTPTIVIVWSILLASIFSLLWVRVDPFLAKSNGPLLEECGLDCN

SEQ ID NO: 18 - protein, 596 aa, Zea mays
MQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKGSKSKKGSDKKKSQKHVDSSVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSLPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTRTCGINC

SEQ ID NO: 19 - protein, 1083 aa, Zea mays
MEASAGLVAGSHNRNELVVIRRDGDPGPKPPPREQNGQVCQICGDDVGLAPGGEPFVACNECAFPVCRDCYEYERREGTQNCPQCRTRYKRLKGCQRVTGDEEEDGVDDLDNEFNWNGHDSRSVADSMLYGRGGDPNGAPQPFQLNPNVPLLTNGQMVDDIPPEQHALVPSFMGGGGKRIHPLPYADPSLPVQPRSMDPSKDLAAYGYGSVAWKERVENWKQRQERMHQTRNDGGGDDGDDADLPLMDESRQPLSRKIPLPSSQINPYRMIIIIRLVVLGFFFHYRVMHPVNDAFALWLISVICEIWFAMSWILDQFPKWFPIERETYLDRLSLRFDKEGQPSQLAPIDFFVSTVDPLKEPPLVTANTVLSILSVDYPVDKVSCYVSDDGAAMLTFEALSETSEFAKKWAPFCKRYNIEPRAPEWYFQQKIDYLKDKVAANFVRERRAMKREYEEFKVRINALVAKAQKVPEEGWTMQDGTPWPGNNVRDHPGMIQVFLGQSGGLDCEGNELPRLVYVSREKRPGYNHHKKAGAMNALVRVSAVLSNAPYLLNLDCDHYINNSKAIKEAMCFMMDPLLGKKVCYVQFPQRFDGIDRHDRYANRNVVFFDINMKGLDGIQGPIYVGTGCVFRRQALYGYDAPKTKKPPSRTCNCWPKWCFCCCCCGNRKHKKKTTKPKTEKKKLLFFKKEENQSPAYALGEIDEAAPGAENEKAGIVNQQKLEKKFGQSSVFATSTLLENGGTLKSASPASLLKEAIHVISCGYEDKTDWGKEIGWIYGSVTEDILTGFKMHCHGWRSIYCIPKRPAFKGSAPLNLSDRLHQVLRWALGSIEIFFSNHCPLWYGYGGGLKFLERFSYINSIVYPWTSIPLLAYCTLPAICLLTGKFITPELNNVASLWFMSLFICIFATSILEMRWSGVGIDDWWRNEQFWVIGGVSSHLFAVFQGLLKVIAGVDTSFTVTSKGGDDDEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKDDGPLLEECGLDCN

SEQ ID NO: 20 - protein, 1079 aa, Zea mays
MEGDADGVKSGRRGGGQVCQICGDGVGTTAEGDVFTACDVCGFPVCRPCYEYERKDGTQACPQCKNKYKRHKGSPAIRGEEGDDTDADDASDFNYPASGNDDQKQKIADRMRSWRMNAGGSGDVGRPKYDSGEIGLTKYDSGEIPRGYIPSVTNSQISGEIPGASPDHHMMSPTGNIGRRAPFPYMNHSSNPSREFSGSVGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKIRVNGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKGSKSKKGSDKKKSQKHVDSSVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSLPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTRTCGINC

SEQ ID NO: 21 - protein, 983 aa, Zea mays; identical to SEQ ID NO: 12

SEQ ID NO: 22 - protein, 790 aa, Zea mays
MEASAGLVAGSHNRNELVVIRRESGAGGGGGGGAARRAEAPCQICGDEVGVGFDGEPFVACNECAFPVCRACYEYERREGSQACPQCRTRYKRLKGCPRVAGDEEEDGVDDLEGEFGLQDGAGHEDDPQYVAESMLRAQMSYGRGGDAHPDFNPVPNVPLLTNGQMVDDIPPEQHALVPSYMGSGGGGKRIHPLPFADSNLPVQPRSMDPSKDLAAYGYGSVAWKERMEGWKQKQERLQHVRSEGGGDWDGDNADLPLMDEARQPLSRKVPISSSRINPYRMIIVIRLVVLGFFFHYRVMHPAKDAFALWLISVICEIWFAMSWILDQFPKWLPIERETYLDRLSLRFDKEGQPSQLAPIDFFVSTVDPTKEPPLVTANTVLSILSVDYPVEKVSCYVSDDGAAMLTFEALSETSEFAKKWVPFSKKFNIEPRAPEWYFQQKIDYLKDKVAASFVRERRAMKREYEEFKVRINALVAKAQKVPEEGWTMQDGSLWPGNNVRDHPGMIQVFLGQSGGRDVEGNELPRLVYVSREKRPGYNHHKKAGAMNALVRVSAVLSNAPYLLNLDCDHYINNSKAIKEAMCFMMDPLVGKKVCYVQFPQRFDGIDRHDRYANRNVVFFDINMKGLDGIQGPIYVGTGCVFRRQALYGYDAPKTKKPPSRTCNCWPKWCLSCCCSRNKNKKKTTKPKTEKKKRLFFKKAENPSPAYALGEIEEGAPGADIEKAGIVNQQKLEKKFGQSSVFVASTLLENGGTLKSASPASLLKEAIHVISCGYEDKTDWGKEVYIPYIT

SEQ ID NO: 23 - protein, 1075 aa, Zea mays
MAANKGMVAGSHNRNEFVMIRHDGDAPGSAKPTKSANGQVCQICGDSVGVSATGDVFVACNECAFPVCRPCYEYERKEGNQCCPQCKTRYKRQKGSPRVHGDEDEEDVDDLDNEFNYKQGNGKGPEWQLQGDDADLSSSARHEPHHRIPRLTSGQQISGEIPDASPDRHSIRSPTSSYVDPSVPVPVRIVDPSKDLNSYGLNSVDWKERVESWRVKQDKNMMQVTNKYPEARGGDMEGTGSNGEDMQMVDDARLPLSRIVPISSNQLNLYRVVIILRLIILCFFFQYRVSHPVRNAYGLWLVSVICEVWFALSWLLDQFPKWYPINRETYLDRLALRYDREGEPSQLAPIDVFVSTVDPLKEPPLITANTVLSILSVDYPVDKVSCYVSDDGSAMLTFESLSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVIKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 24 - protein, 1076 aa, Zea mays
MDGGDATNSGKHVAGQVCQICGDGVGTAADGDLFTACDVCGFPVCRPCYEYERKDGTQACPQCKTKYKRHKGSPPVHGEENEDVDADDVSDYNYQASGNQDQKQKIAERMLTWRTNSRGSDIGLAKYDSGEIGHGKYDSGEIPRGYIPSLTHSQISGEIPGASPDHMMSPVGNIGRRGHQFPYVNHSPNPSREFSGSLGNVAWKERVDGWKMKDKGAIPMTNGTSIAPSEGRGVADIDASTDYNMEDALLNDETRQPLSRKVPIPSSRINPYRMVIVLRLAVLCIFLRYRITHPVNNAYPLWLLSVICEIWFALSWILDQFPKWSPINRETYLDRLALRYDREGEPSQLAPVDIFVSTVDPMKEPPLVTANTVLSILAVDYPVDKVSCYVSDDGAAMLTFDALSETSEFARKWVPFCKKYNIEPRAPEWYFAQKIDYLKDKVQTSFVKERRAMKREYEEFKVRINGLVANAQKVPEEGWIMQDGTPWPGNNTRDHPGMIQVFLGHSGGLDVEGNELPRLVYVSREKRPGFQHHKKAGAMNALVRVSAVLTNGQYMLNLDCDHYINNSKALREAMCFLMDPNLGRNVCYVQFPQRFDGIDRNDRYANRNTVFFDINLRGLDGIQGPVYVGTGCVFNRTALYGYEPPVKKKKPGFFSSLCGGRKKTSKSKKSSEKKKSHRHADSSVPVFNLEDIEEGIEGSQFDDEKSLIMSQMSLEKRFGQSSVFVASTLMEYGGVPQSATPESLLKEAIHVISCGYEDKTDWGTEIGWIYGSVTEDILTGFKMHARGWRSIYCMPKRPAFKGSAPINLSDRLNQVLRWALGSIEILFSRHCPIWYGYGGRLKFLERFAYINTTIYPLTSIPLLLYCILPAVCLLTGKFIIPKISNLESVWFISLFISIFATGILEMRWSGVGIDEWWRNEQFWVIGGISAHLFAVFQGLLKVLAGIDTSFTVTSKATDEEGDFAELYMFKWTTLLIPPTTILIINLVGVVAGISYAINSGYQSWGPLFGKLFFAFWVIVHLYPFLKGLMGKQNRTPTIVVVWAILLASIFSLMWVRIDPFTTRVTGPDIAKCGINC

SEQ ID NO: 25 - protein, 1089 aa, Zea mays
MEASAGLVAGSHNRNELVVIRRDGEPGPKPMDQRNGQVCQICGDDVGRNPDGEPFVACNECAFPICRDCYEYERREGTQNCPQCKTRFKRLKGCARVPGDEEEDGVDDLENEFNWSDKHDSQYLAESMLHAHMSYGRGADLDGVPQPFHPIPNVPLLTNGQMVDDIPPDQHALVPSFVGGGGKRIHPLPYADPNLPVQPRSMDPSKDLAAYGYGSVAWKERMESWKQKQERMHQTRNDGGGDDGDDADLPLMDEARQPLSRKIPLPSSQINPYRMIIIIRLVVLCFFFHYRVMHPVPDAFALWLISVICEIWFAMSWILDQFPKWFPIERETYLDRLSLRFDKEGHPSQLAPVDFFVSTVDPLKEPPLVTANTVLSILSVDYPVDKVSCYVSDDGAAMLTFEALSETSEFAKKWVPFCKRYSLEPRAPEWYFQQKIDYLKDKVAPNFVRERRAMKREYEEFKVRINALVAKAQKVPEEGWTMQDGTPWPGNNVRDHPGMIQVFLGQSGGHDVEGNELPRLVYVSREKRPGYNHHKKAGAMNALVRVSAVLTNAPYLLNLDCDHYINNSKAIKEAMCFMMDPLLGNKVCYVQFPQRFDGIDRHDRYANRNVVFFDINMKGLDGIQGPIYVGTGCVFRRQALYGYDAPKTKKPPSRTCNCWPKWCICCCCFGNRKTKKKTKTSKPKFEKIKKLFKKKENQAPAYALGEIDEAAPGAENEKASIVNQQKLEKKFGQSSVFVASTLLENGGTLKSASPASLLKEAIHVISCGYEDKTGWGKDIGWIYGSVTEDILTGFKMHCHGWRSIYCIPKRAAFKGSAPLNLSDRLHQVLRWALGSIEIFFSNHCPLWYGYGGGLKFLERFSYINSIVYPWTSIPLLAYCTLPAICLLTGKFITPELNNVASLWFMSLFICIFATSILEMRWSGVGIDDWWRNEQFWVIGGVSSHLFAVFQGLLKVIAGVDTSFTVTSKGGDDEEFSELYTFKWTTLLIPPTTLLLLNFIGVVAGISNAINNGYESWGPLFGKLFFAFWVIVHLYPFLKGLVGRQNRTPTIVIVWSILLASIFSLLWVRIDPFLAKDDGPLLEECGLDCN

SEQ ID NO: 26 - protein, 1033 aa, Glycine max
MEASAGLVAGSHNRNELVVIHGHEEHKPLKNLDGQVCEICGDDVGLTVDGDLFVACNECGFPACRPCYEYERREGRQVCPQCKTRYKRLKGSPRVEGDDDEEDVDDIEHEFNIEEQNKHNHSAEAMLHGKMSYGRGPEDDENAQFPAVIAGGRSRPVSGELPIASHYGDQMLASSLQNRSHPYLASDPRNGKLDEAKEDRMDDWKLQQGNLGHEPDEDPDAAMLDEARQPLSRKVPIASSKVNPYRMVIVARLVILAFFLRYRLMNPVHDALGLWLTSIICEIWFAFSWILDQFPKWFPIDRETYLDRLSIRYEREGEPNMLAPVDVFVSTVDPMKEPPLVTANTVLSILAMDYPVDKISCYISDDGASMCTFEALSETAEFARKWVPFCKKFSIEPRAPEMYFSEKVDYLKDKVQPTFVKDRRAMKREYEEFKVRINALVAKAQKVPQGGWIMQDGTPWPGNNTKDHPGMIQVFLGHSGGHDTEGNELPRLVYVSREKRPGFQHHKKAGAMNALIRVSAVLTNAPFMLNLDCDHYVNNSKAAREAMCFLMDPQTGKKVCYVQFPQRFDGIDRHDRYANRNTVFFDINMKGLDGIQGPAYVGTGCVFRRQALYGYNPPKGPKRPKMVSCDCCPCFGKRKKVKYEGNDANGEAASLRGMDDDKEVLMSQMNFEKKFGQSSIFVTSTLMEEGGVPPSASPASQLKEAIHVISCGYEDKTEWGIELGWIYGSITEDILTGFKMHCRGWRSIYCMPKRAAFKGTAPINLSDRLNQVLRWALGSIEIFFSRHCPLWYGYKEGKLKWLERFAYANTTVYPFTSIPLVAYCVLPAVCLLTDKFIMPPISTFAGLYFVALFSSIIATGLLELKWSGVSIEEWWRNEQFWVIGGVSAHLFAVIQGLLKVLAGIDTNFTVTSKAADDEEFGELYTFKWTTLLIPPTTILIINIVGVVAGISDAINNGYQSWGPLFGKLFFSFWVIVHLYPFLKGLMGRQNRTPTIVVIWSVLLASIFSLLWVRIDPFVLKTKGPDTKLCGINC

SEQ ID NO: 27 - protein, 1078 aa, Glycine max
MDTKGRLVAGSHNRNEFVLINADETARVAVTELSGQICQICGDELEVTVNGEPFVACNECAFPVCRPCYEYERREGNQVCPQCKTRYKRIKGSPRVEGDEEEDDSDDLESEFDIGSVFSARLNYGSQVNGSVIHAPSEFDAASVASEIPLLTYGQEDVGISADKHALILPPFTARGKRVHPMPFPDSSVPVQPRPMDPKKDIAVYGYGSVAWKERMEDWKKKQSEKLQVVRHEGGKDSDELDDPDLPKMDEGRQPLWRKLPISSSRINPYRIIIVLRIAILCLFFHYRILHPVNDAYALWLTSVICEIWFAVSWIFDQFPKWSPILRETYLDRLSLRYEKEGKPSLLADIDVFVSTVDPMKEPPLITANTVLSILAVDYPVDKVACYVSDDGAAMLTFEALSETSEFARKWVPFCKKFCIEPRAPEWYFAQKVDYLKDKVDATFIRERRAIKREYEEFKVRINALVALAQKVPEDGWTMQDGTPWPGNNVRDHPGMIQVFLGQNGVRDIEGNELPRLVYVSREKRPGYDHHKKAGAMNALVRVSAIITNAPYVLNVDCDHYINNSKALREAMCFMMDPTSGKKICYVQFPQRFDGIDRHDRYSNRNVVFFDINMKGLDGIQGPIYVGTGCVFRRQAFYGYDAPTSKKAPRKTCNCWPKWCCCLCCGSKKKKIKAKSSVKKKIKNKDDIKQMHALENIEEGIEGIDNEKSSLMSQSKFEKKFGQSSVFIASTLLEDGGVPKAASSATLLKEAIHVISCGYEDKTEWGKEVGWIYGSVTEDILTGFKMHCHGWRSVYCMPKRPAFKGSAPINLSDRLHQVLRWALGSVEIFFSRHCPIWYGYGGGLKSLERFSYINSVVYPLTSIPLIAYCALPAVCLLTGKFIVPEISNYASIIFMALFISIAATGILEMQWGGVGIHDWWRNEQFWVIGGASSHLFALFQGLLKVLAGVNTNFTVTSKAADDGEFADLYIFKWTSLLIPPLTLLIINIIGVIVGVSDAINNGYDSWGPLFGRLFFALWVIVHLYPFLKGVMGKQEGVPTIILVWAILLSSILTLLWVRINPFLAKSDVVLEICGLNCD

SEQ ID NO: 28 - protein, 1079 aa, Glycine max
MESEGEAGAKPVTALGAQVCQICGDGVGKTVDGEPFVACDVCAFPVCRPCYEYERKDGNQSCPQCKTRYKRHKGSPAILGDMEEDGAAAADASDFNYDSENQNQNQNQKQKISERMLSWQLTYPRGEEVGAPNYDKDVSHNHIPLLTSGQEVSGELSAASPERLSMASPAVGGGKRVHNIPYSSDINQSPNIRAGDPGLGNVAWKERVDGWKMKQEKNVVPMSTGQAASERGAGDIDASTDVLVDDSLLNDEARQPLSRKVSIPSSRINPYRMVIMLRLVILCIFLHYRITNPVPNAYPLWLVSVICEIWFAISWILDQFPKWLPVNRETYLDRLALRYDREGEPSQLAAVDIFVSTVDPLKEPPLVTANTVLSILAVDYPVDKVSCYVSDDGAAMLTFEALAETSEFARKWVPFSKKYSIEPRAPEWYFSQKIDYLKDKVHPSFVKDRRAMKREYEEFKVRINGLVSKAQKVPEEGWVMQDGTPWPGNNTRDHPGMIQVFLGQSGGLDTEGNELPRLVYVSREKRPGFQHHKKAGAMNALVRVSAVLTNGPFLLNLDCDHYINNSKALREAMCFMMDPNLGKHVCYVQFPQRFDGIDRNDRYANRNTVFFDINLRGLDGIQGPVYVGTGCVFNRTALYGYEPPLKPKHKKPGLLSSLCGGTRKKSSKSSKKGSDKKKSSKHVDPTVPIFNLEDIEEGVEGTGFDDEKSLLMSQMSLEKRFGQSAVFVASTLMENGGVPQSATPETLLKEAIHVISCGYEDKTDWGSEIGWIYGSVTEDILTGFKMHARGWRSIYCMPKRPAFKGSAPINLSDRLNQVLRWALGSVEILFSRHCPIWYGYGGRLKWLERFAYVNTTIYPVTAIPLLIYCILPAVCLLTNKFIIPQISNLASIWFISLFLSIFATGILEMRWSGVGIDEWWRNEQFWVIGGVSAHLFAVFQGLLKVLAGIDTNFTVTSKASDEDGDFAELYMFKWTTLLIPPTTLLIINLVGVVAGISYAINSGYQSWGPLFGKLFFAFWVIIHLYPFLKGLMGRQNRTPTIVVVWSVLLASIFSLLWVRIDPFTTRVTGPDVEECGINC

SEQ ID NO: 29 - protein, 973 aa, Glycine max
MEACTGLFAGTPNSNELVVIQGHDEPKPVKNLDGQLCEICGDSVGLTVDGDLFVACEECGFPVCRPCYEYERREGTQVCPQCHTRYKRIKGSPRVLGDEDEDDVDDIEHEFKHEEMLQGNMTHGDSEGNSKSKPVGLAKVNGELPVSSHSVGEPGAKLDDKEKVDEWMLHQGNLWPETDASVDPEKAMKEPLSRKVPIPSGRLSPYRMMVVARLLLLLLFFQYRIFHPVPDAIGLWFISVTCEIWLALSWMIDQLPKWFPIDRETYLDRLSIRFEPENKPNMLSPIDIIVTTVDPIKEPPLVTANTVLSILALDYPADKISCYVSDDGASMLTFEALQETAEFSRKWVPFCKTFSVEPRAPEKYFSEKIDFLKDKLQSTYVKERRTMKREYEEFKVRINALVAKSMRVPPEGWTMKDETPWPGNNSKDHPSMIQVLLPHNVGNELPCLVYTSREKRPAFQHHNKAGAINAMLRVSAVLSNAPFVLNLDCNHYVNNSKVVREAMCFFMDIQLGNGIAFVQFPLRFDSLDRNDRYANKNTVLFDINLRCLDGIQGPAYIGSACIFRRKALTGFDSPKTSKRPSMVQVHSKQDENGEEASITGEDKELLKSEMNDENKFGKSILFMNSALAEEGGVDPSSSQEALLKEAIHVMSSRYEDRTLWGYEVGLSYGSIAADTLTSLKMHCGGWRSVYCMPKRDPFRGTAPINLTDRLNQVLRWAVGSLQILFSSHCPLLYGGRLKGLQRIAYINSTVYPFSSIPLLIYCIIPAICLLTDKFITPSVGTFASLIFIALFISIFASAILELRWSGVSLEEWWRSQQFWVIGSVSANLFALLQGIMRALPLGRVNTNFSIVSKAPDDVEFRELYAIRWTALLIPPTTIIIINLIGIVAGFTDAINSGEHSWGALLGKLFFSLWVVIHLYPFLKGLMGRQNRTPTLIVIWSVLLASIFSLVWVRVDPFVLKTKGPDVKQCGISC

SEQ ID NO: 30 - protein, 975 aa, Glycine max
MMESGAHFCNSCGEQIGLDANGEVFVACHECYFPICKACFEYEINEGRKVCLRCATPYADRAKDNNDTKVYENQSTTAAQINVSQDVGLHARHVSTVSTVDSELNDESGNPIWKNRVESWKEKDKKKKKKKSAPKAENEAPIPPEQQMEEMQSSEAAAAEPLSMVIPISKTRLAPYRTVIIVRLIILGLFFHYRVTNPVDSAFGLWLTSIICEIWFAFSWVLDQFPKWSPVNREAFIDRLSLRYERPGEPSQLAAVDFFVSTVDPLKEPPLITANTVLSILAVDYPVDKVSCYVSDDGAAMLSFESLVETADFARKWVPFCKKFSIEPRAPEFYFSQKIDYLKDKVQPSFVKERRAMKREYEEFKVRVNALVAKAQKTPDEGWTMQDGTSWPGNNSRDHPGMIQVFLGHSGAHDIEGNELPRLVYVSREKRPGYQHHKKAGAENALVRVSAVLTNAPFILNLDCDHYVNNSKAVREAMCFLMDPVVGRDLCYVQFPQRFDGIDRSDRYANRNTVFFDVNMKGLDGIQGPMYVGTGCVFNRQALYGYSPPSMPKLPKSSSCCCCPSKKQTKDVSELYRDAKREELDAAIFNLREIDNYDEYERSMLISQMSFEKTFGLSTVFIESTLMENGGLPESADPSMLIKEAIHVISCGYEEKTAWGKEIGWIYGSVTEDILTGFKMQCRGWRSVYCMPLRPAFKGSAPINLSDRLHQVLRWALGSVEIFFSRHCPLWYGFAGGRLKWLQRLAYINTIVYPFTSLPLVAYCTLPAICLLTGKFIIPTLSNLASALFLGLFLSIIVTSVLELRWSGVTIEALWRNEQFWVIGGVSAHLFAVFQGFLKMLAGVDTNFTVTAKAADDTEFGDLYIIKWTTLLIPPTTLIIINMVGVVAGFSDALNGGYESWGPLFGKVFFAFWVIFHLYPFLKGLMGRQNRTPTIVILWSVLLASVFSLVWVKINPFISRPDSASISQTCISIDC

SEQ ID NO: 31 - protein, 1039 aa, Glycine max
MEASAGLVAGSHNRNELVVIHGHEEPKALKNLDGQVCEICGDGVGLTVDGDLFVACNECGFPVCRPCYEYERREGSHLCPQCKTRYKRLKGSPRVEGDDDEEDVDDIEHEFNIDEQKNKHGQVAEAMLHGRMSYGRGPEDDDNSQFPTPVIAGGRSRPVSGEFPISSNAYGDQMLSSSLHKRVHPYPVSEPGSARWDEKKEDGWKDRMDDWKLQQGNLGPEPDEDPDAAMLDEARQPLSRKVPIASSKINPYRMVIVARLVILAFFLRYRLMNPVHDALGLWLTSIICEIWFAFSWILDQFPKWFPIDRETYLDRLSIRYEREGEPNMLAPVDVFVSTVDPMKEPPLVTANTVLSILAMDYPVDKISCYISDDGASMCTFESLSETAEFARKWVPFCKKFSIEPRAPEMYFSEKIDYLKDKVQPTFVKERRAMKREYEEFKVRINALVAKAQKVPQGGWIMQDGTPWPGNNTKDHPGMIQVFLGSSGGLDTEGNQLPRLVYVSREKRPGFQHHKKAGAMNALVRVSAVLTNAPFMLNLDCDHYVNNSKAAREAMCFLMDPQTGKKVCYVQFPQRFDGIDTHDRYANRNTVFFDINMKGLDGIQGPVYVGTGCVFRRQALYGYNPPKGPKRPKMVSCDCCPCFGSRKKYKEKNDANGEAASLKGMDDDKEVLMSQMNFEKKFGQSSIFVTSTLMEEGGVPPSSSPAALLKEAIHVISCGYEDKTEWGLELGWIYGSITEDILTGFKMHCRGWRSIYCMPKRAAFKGTAPINLSDRLNQVLRWALGSIEIFFSHHCPLWYGFKEKKLKWLERFAYANTTVYPFTSIPLVAYCILPAVCLLTDKFIMPPISTFAGLYFVALFSSIIATGILELKWSGVSIEEWWRNEQFWVIGGVSAHLFAVIQGLLKVLAGIDTNFTVTSKATDDEEFGELYTFKWTTLLIPPTTILIINIVGVVAGISDAINNGYQSWGPLFGKLFFSFWVIVHLYPFLKGLMGRQNRTPTIVVIWSVLLASIFSLLWVRIDPFVLKTKGPDTKLCGINC

SEQ ID NO: 32 - protein, 967 aa, Glycine max
METNLGLVAGSHNSNEFIIIRQDGDFAQRELQPLLHGKICQLCGDDIGVNEDGDLFVACNECAFPVCKSCYEYERREGNQVCPQCKTRFKRLKGCARVEGDEEEDIDDDLENEFDFDDGQSKLHDMKTSMSHEEQGEETSQEHNALVTSSSTILGKEIVALQARPMDPSKDLAAYGYGSIAWKEKMKIWKQRQMKISDMKKENDNEDPDNTVEDDDTEFLITYLDRLSLRYEKEGKPSQLSPIDIFVISMDPLKEPPLVTANTVLSILAIDYPAEKVSCYVSDDGAAMLTFEALSETSEFAKKWVPFCKKFNIEPRAPERYFAEKINFLDDKVQPSFVKERRAMKREYEEFRVRINTLVAKSRKVPEEGWTMQDGTPWPGNNVRDHPGMIQVFLGETGGCDMDGKELPRLVYVSREKRPKFNHQKKAGALNALVRVSAVLSNAPFVLNLDYNHCINNSKVVREAMCFMMDPLLGKGASYVQFSQRFDGIASDEQYANQTNGFIDINMKGLDGIQGPTYIGTGCVFRRQALYGFDSPRKKKPPTKTCNCWPKWCCFGCCFMGKRKKKKLKKPKFEITETSHRKVHSESSIVEGKEDETSAHLSNPKFVKKYGQSPIFIASIQLVDGETLKHGNLASQLTEAIHVISCGYEEKTEWGKEVGWIYGSVTEDILTGFKMHCHGWRSIYCTPRRPGFKVSTPRNLSNGLQQVFQWALGSIEIFMSKHCPLWYGYGGGLKWLQRISYINAIVYPWTSIPLVVYCTLPAICLLTGKFIIPELSNAAGMWFVSLFFCIFTTSVLEMRWSGVTVDEWWRNEQFWVIGGVSAHFLAVFLGMFKVLAGVKTNFIVASKVDDKEHSNMFALKWTTLLIIPTTLLVLNIIAVVAGVSYAINNGFESWGPLLGKLLFSLWVILHLYPFLKGMIGRHNRTPTIVLVWAILLASFFSVLWVKIDPFLPKSDGPILEECGLDCN

SEQ ID NO: 33 - protein, 990 aa, Glycine max
MRTPTSLTHAYLHWFHSPLTMEASTGLFAGTPNSNELVVIQGHDEPKPVKNLDGQLCEICGDSVGLTVDGDLFVACEECGFPVCRPCYEYERREGTQVCPQCHTRYKRTKGSPRVLGDEDEDDVDDIEHEFKHEEMLQGNKTHRDSDVGLAKVNGELPISSNSVEEPGAKLDDKEKVDEWMLHQGNLWPETDASDDPVKAMKEPLSRKVPIPSGRLSPYRMMVVARLLLLLLFFQYRIFHPVPDAIGLWFISVTCEIWLALSWMIDQLPKWFPIDRETYLDRLSIRFEPENKPNMLSPIDIIVTTVDPIKEPPLVTANTVLSILALDYPADKISCYVSDDGASMLTFEVLQETAEFSRKWVPFCKKFSVEPRAPEKYLTEKIDFLKDKLQSTYVKERRTMKREYEEFKVRINALVAKSMRVPPEGWTMKDETPWPGNNSKDHPSMIQVLLPHNVGNELPCLVYTSREKRPAFQHHNKAGAINAMLRVSAVLNNAPFVLNLDCNHYVNNSKVVREAMCFFMDIQLGNGIGFVQFPLRFDSLDRNDRYANKNTVLFDINLRCLDGIQGPAYVGSACIFRRKALTGFDSPKASKRPSMVQVHSKQDENGEEASKTAAATDEDKELLKSENKFGMSTIFMNSSWTEEGGVDPSSSQEALLKEAIHVMNSRYEDRTLWGYEVGLSYGSIATDTLTSMKMHCGGWRSVYCMPKRDPFRGTAPINLTERLNQVLRWAVGSLQILFSSHCPLVYGLNGGRLKGLQRIAYINSTVYPFTSIPLLIYCTIPAICLLTDKFITPSVGTFASLIFIALFISIFASAILELRWSRVSLEEWWRSQQFWVIGSVSANLFAVLQGIMGALPLSSRVNKNFSIVSKAPDEVEFRELYAIRWTALLIPPTTIIIINLIGIVAGFTDAINSGEHSWGALLGKLFFSLWVIVHLYPFLKGLMGRQNRTPTLIVIWSVLLASIFSLVWVRVDPFVLKTKGPDVKQCGISC

SEQ ID NO: 34 - protein, 1084 aa, Glycine max
MEASAGMVAGSHKRNELVRIRHDSSDSGSKPLKSLNGQICQICGDTVGLTATGDVFVACNECAFPVCRPCYEYERKDGNQSCPQCKTRYKRHRGSPRVEGDEDEDDSDDIENEFNYAQGKAKARRQWEDDADLSSSSRRESQQPIPLLTNGQTMSGEIPCATPDTQSVRTTSGPLGPSEKVHSLPYVDPRQPVPVRIVDPSKDLNSYGLGNVDWKERVEGWKLKQEKNMVQMTGRYTEGKGGDVEGTGSNGEELQMVDDARQPMSRVVPIPSSQLTPYRVVIILRLIILGFFLQYRVTHPVKDAYPLWLTSVICEIWFALSWLLDQFPKWSPINRETYLERLALRYDREGEPSQLDPVDVFVSTVDPLKEPPLVTANTVLSILSVDYPVDKVSCYVSDDGSAMLTFEALSETAEFAKKWVPFCKKHNIEPRAPEFYFAQKIDYLKDKIQPSFVKERRAMKREYEEFKVRINALVAKAQKMPEEGWTMQDGTAWPGNNPRDHPGMIQVFLGHSGGLDTDGNELPRLVYVSREKRPGFQHHKKAGAMNALIRVSAVLTNGAYLLNVDCDHYFNNSKALKEAMCFMMDPVIGKKTCYVQFPQRFDGIDLHDRYANRNIVFFDINMKGQDGVQGPVYVGTGCCFNRQALYGYDPVLTEEDLEPNIIVKSCWGSRKKGKGGNKKYSDKKKAMGRTESTVPIFNMEDIEEGVEGYDDERTLLMSQKSLEKRFGQSPVFIAATFMEQGGIPPSTNPATLLKEAIHVISCGYEDKTEWGKEIGWIYGSVTEDILTGFKMHARGWISIYCMPPRPAFKGSAPINLSDRLNQVLRWALGSIEIFLSRHCPLWYGYNGKLKPLMRLAYINTIVYPFTSIPLIAYCTLPAFCLLTNKFIIPEISNFASMWFILLFVSIFTTSILELRWSGVSIEDWWRNEQFWVIGGTSAHLFAVFQGLLKVLAGIDTNFTVTSKASDEDGDFAELYVFKWTSLLIPPTTVLIVNLVGIVAGVSYAINSGYQSWGPLFGKLFFAIWVIAHLYPFLKGLLGRQNRTPTIVIVWSVLLASIFSLLWVRIDPFTSDSNKLTNGQCGINC

SEQ ID NO: 35 - protein, 1084 aa, Glycine max
MEASAGMVAGSHKRNELVRIRHDSSDSGSKPMKNLNGQICQICGDTVGLTATGDVFVACNECAFPVCRPCYEYERKDGNQSCPQCKTRYKRHRGSPRVEGDEDEDDSDDIENEFNYAQGKAKARRQWEDDPDLSSSSRRESQQPIPLLTNGQTMSGEIPCATPDTQSVRTTSGPLGPSEKVHSLPYVDPRQPVPVRIVDPSKDLNSYGLGNVDWKERVEGWKLKQEKNMVQMTGRYAEGKGGDVEGTGSNGEELQMVDDARQPMSRVVPIPSSQLTPYRVVIILRLIILGFFLQYRVTHPVKDAYPLWLTSVICEIWFALSWLLDQFPKWSPINRETYLERLALRYDREGEPSQLDPVDVFVSTVDPLKEPPLVTANTVLSILSVDYPVDKVSCYVSDDGSAMLTFEALSETAEFAKKWVPFCKKHNIEPRAPEFYFAQKIDYLKDKIQPSFVKERRAMKREYEEFKVRINALVAKAQKMPEEGWTMQDGTPWPGNNPRDHPGMIQVFLGHSGGLDTDGNELPRLVYVSREKRPGFQHHKKAGAMNALIRVSAVLTNGAYLLNVDCDHYFNNSKALKEAMCFMMDPVLGKKTCYVQFPQRFDGIDLHDRYANRNIVFFDINMKGQDGVQGPVYVGTGCCFNRQALYGYDPVLTEEDLEPNIIVKSCCGSRKKGKGGNKKYSDKKKAMGRTESTVPIFNMEDIEEGVEGYDDERTLLMSQKSLEKRFGQSPVFIAATFMEQGGIPPSTNPATLLKEAIHVISCGYEDKTEWGKEIGWIYGSVTEDILTGFKMHARGWISIYCMPPRPAFKGSAPINLSDRLNQVLRWALGSIEIFLSRHCPLWYGYNGKLKPLMRLAYINTIVYPFTSIPLIAYCTLPAFCLLTNKFIIPEISNFASMWFILLFVSIFTTSILELRWSGVSIEDWWRNEQFWVIGGTSAHLFAVFQGLLKVLAGIDTNFTVTSKASDEDGDFAELYVFKWTSLLIPPTTVLIVNLVGIVAGVSYAINSGYQSWGPLFGKLFFAIWVIAHLYPFLKGLLGRQNRTPTIVIVWSVLLASIFSLLWVRIDPFTSDSNKLTNGQCGINC

SEQ ID NO: 36 - protein, 976 aa, Glycine max
MMESGAHFCNSCGEQIGLDANGELFVACHECYFPICKACFEYEINEGRKVCLRCATPYSDRVKDNDGTKVYENQSTTAAQINVSQDVGLHARHVSTVSTVDSELNDESGNPIWKNRVESWKEKDKKKKKKKKSVPKAENEAPIPPEQQMEEIQSSEASAAEPLSMVIPISKTRLAPYRTVIIVRLIILGLFFHYRVTNPVDSAFGLWLTSIICEIWFAFSWVLDQFPKWSPVNREAFVDRLSARYERPGEPSQLAAVDFFVSTVDPLKEPPLITANTVLSILAVDYPVDKVSCYVSDDGAAMLTFESLVETADFARMWVPFCKKFSIEPRAPEFYFSQKIDYLKDKVQPSFVKERRAMKREYEEFKVRVNALVAKAQKTPDEGWTMQDGTSWPGNNSRDHPGMIQVFLGHSGAHDVEGNELPRLVYVSREKRPGYQHHKKAGAENALVRVSAVLTNAPFILNLDCDHYVNNSKAVREAMCFLMDPVVGRDLCYVQFPQRFDGIDRSDRYANRNTVFFDVNMKGLDGIQGPMYVGTGCVFNRQALYGYSPPSMPKLPKSSSCCCCPSKKQTKDVSELYRDAKREELDAAIFNLREIDNYDEYERSMLISQMSFEKTFGLSTVFIESTLMENGGLPESSDPSMLIKEAIHVISCGYEEKTAWGKEIGWIYGSVTEDILTGFKMQCRGWRSVYCMPLRPAFKGSAPINLSDRLHQVLRWALGSVEIFFSRHCPLWYGFAGGRLKWLQRLAYINTIVYPFTSLPLVAYCTLPAICLLTGKFIIPTLSNLASALFLGLFLSIIVTSVLELRWSGVTIEALWRNEQFWVIGGVSAHLFAVFQGFLKMLAGVDTNFTVTAKAADDTEFGELYIIKWTTLLIPPTTLIIINIVGVVAGFSDALNGGYESWGPLFGKVFFAFWVIFHLYPFLKGLMGRQNRTPTIVILWSVLLASVFSLVWVKINPFISRPDSASISQTCISIDC

SEQ ID NO: 37 - protein, 1039 aa, Glycine max
MEASAGLVAGSHNRNELVVIHGHEEPKALKNLDGQVCEICGDGVGLTVDGDLFVACNECGFPVCRPCYEYERREGSQLCPQCKTRYKRLKGSPRVEGDDDEEDVDDIEHEFNIDEQTNKHGQVAEAMLHGKMSYGRGPEDDENSQFPTPVIAGGRSRPVSGEFPLSSNVYGDQMLSSSLHKRVHPYPVSEPGSARWDEKKEDGWKDRMDDWKLQQGNLGPEPDEDPDAAMLDEARQPLSRKVPIASSKINPYRMVIVARLVILAFFLRYRLMNPVHDALGLWLTSIICEIWFAFSWILDQFPKWFPIDRETYLDRLSIRYEREGEPNMLAPVDVFVSTVDPMKEPPLVTANTVLSILAMDYPVDKISCYISDDGASMCTFESLSETAEFARKWVPFCKKFSIEPRAPEMYFSEKIDYLKDKVQPTFVKERRAMKREYEEFKVRINALVAKAQKVPQGGWIMQDGTPWPGNNTKDHPGMIQVFLGSSGGLDTEGNQLPRLVYVSREKRPGFQHHKKAGAMNALVRVSAVLTNAPFMLNLDCDHYVNNSKAAREAMCFLMDPQTGKKVCYVQFPQRFDGIDTHDRYANRNTVFFDINMKGLDGIQGPVYVGTGCVFRRQALYGYNPPKGPKRPKMVSCDCCPCFGSRKKYKEKSNANGEAARLKGMDDDKEVLMSQMNFDKKFGQSSIFVTSTLMEEGGVPPSSSPAALLKEAIHVISCGYEDKTEWGLELGWIYGSITEDILTGFKMHCRGWRSIYCMPKRAAFKGTAPINLSDRLNQVLRWALGSIEIFFSHHCPLWYGFKEKKLKWLERFAYANTTVYPFTSIPLVAYCILPAVCLLTDKFIMPPISTFAGLYFVALFSSIIATGILELKWSGVSIEEWWRNEQFWVIGGVSAHLFAVIQGLLKVLAGIDTNFTVTSKATDDEEFGELYTFKWTTLLIPPTTILIINIVGVVAGISDAINNGYQSWGPLFGKLFFSFWVIVHLYPFLKGLMGRQNRTPTIVVIWSVLLASIFSLLWVRIDPFVLKNKGPDTKLCGINC

SEQ ID NO: 38 - protein, 1097 aa, Glycine max
MHTGGRLVAGSHNRNEFVLINADENGRIKSVRELSGQICQICGDEIEITVDGEPFVACNECAFPVCRPCYEYERREGNQACPQCKTRYKRIKGSPRVEGDEEEDDTDDLDNEFDYGDIDALGPQPMSESLYSGRPNTGRGANNGSGLATNLEHGSSALNSDIPLLTYGEEDPEISSDRHALIVPPYVNHGSRVHPMPYTDPSIPLQPRPMVPKKDIAVYGYGSVAWKDRMEDWKKRQSDKLQVVKHEGSNDGNFGDDFEDPDLPMMDEGRQPLSRKLPIPSSKINPYRMIIILRLVVLGLFFHYRILHPVNDAYGLWLTSVICEIWFAVSWIMDQFPKWYPIQRETYLDRLSLRYEKEGKPSELSSVDVFVSTVDPMKEPPLITANTVLSILAVDYPVDKVACYVSDDGAAMLTFEALSETSEFARRWVPFCKKYNIEPRAPEWYFGQKMDYLKNKVHPAFVRERRAMKRDYEEFKVRINSLVATAQKVPEDGWTMQDGTPWPGNNVRDHPGMIQVFLGQDGVRDVEGNELPRLVYVSREKRPGFDHHKKAGAMNALVRASAIITNAPYLLNVDCDHYINNSKALREAMCFMMDPQLGKKVCYVQFPQRFDGIDRHDRYSNRNVVFFDINMKGLDGIQGPIYVGTGCVFRRYALYGYDAPAKKKPPSKTCNCWPKWCCLCCGSRKKKNANSKKEKKRKVKHSEASKQIHALENIEAGNEGTNNEKTSNLTQTKLEKRFGQSPVFVASTLLDDGGVPHGVSPASLLKEAIQVISCGYEDKTEWGKEVGWIYGSVTEDILTGFKMHCHGWRSVYCIPKRPAFKGSAPINLSDRLHQVLRWALGSVEIFFSRHCPIWYGYGGGLKLLERFSYINSVVYPWTSLPLLVYCTLPAICLLTGKFIVPEISNYASLVFMALFISIAATGILEMQWGGVSIDDWWRNEQFWVIGGVSSHLFALFQGLLKVLAGVNTNFTVTSKAADDGEFSELYIFKWTSLLIPPMTLLIMNIVGVVVGISDAINNGYDSWGPLFGRLFFALWVILHLYPFLKGLLGKQDRMPTIILVWSILLASILTLMWVRINPFVSRDGPVLEICGLNCDES

SEQ ID NO: 39 - protein, 989 aa, Glycine max
MVQSSVPLCNTCGEQVGLNDNGEVFVACHECNFPICKDCFEHEINEDHRVCMRCGTPYEERTKEEDDFHEIKVHENEDDDFHEIKVHENQSATPSEISNSQDVGLHARHVSTVSAVDSEVNEESGKSIWKNRVESWKGKDKKNKKKKSAPKEEKEASIPPEQQMEETRPAEAAAAPLSVVIPMSKSKIAPYRTVIIMRLIILGLFFHYRVTNPVESAFPLWLTSIICEIWFAFSWVLDQFPKWSPINRQTFIDNLSARFEREGEPNELAAVDFFVSTVDPLKEPPLITANTVLSILAVDYPVDKVSCYVSDDGAAMLTFESLVETADFARKWVPFCKKFSIEPRAPEFYFSQKIDYLKDKVQPSFVKERRAMKRDYEEYKVRVNAMVAKAQKTPEEGWTMQDGTPWPGNNSRDHPGMIQVFLGHTGARDIEGNELPRLVYVSREKRPGYQHHKKAGAENALVRVSAVLTNAPFILNLDCDHYVNNSKAVREAMCFLMDPEVGRDVCYVQFPQRFDGIDRSDRYANRNTVFFDVNMKGLDGIQGPVYVGTGCVFNRQALYGYSPPSMPSVPRSSCCCFPSKKSTNDVSDFQRNAKREELEAAIFNLKELDNYDEHERSMLISQMSFEKTFGLSTVFIESTLMENGGVPESADPSMLIKEAIHVISCGYEEKTLWGKEIGWIYGSVTEDILSGFKMQCRGWKSIYCMPLRPAFKGSAPINLSDRLHQVLRWALGSIEIFLSRHCPLWYGFSGGRLKWLQRMAYINTIVYPFTSLPLIAYCSLPAICLLTGKFIIPTLSNVASVLFLGLFLSIIITSVLELRWSGVSIEDLWRNEQFWVIGGVSAHLFAVFQGLLKMLAGVDTNFTVTAKAAEDSEFGELYLVKWTTLLIPPTTLIVVNMVGVVAGFSDALNGGYESWGPLFGKVFFAFWVIFHLYPFLKGLMGRQNRTPTIVILWSVLLASVFSLIWVKINPFVNTVDSETIAETCIAIDC

SEQ ID NO: 40 - protein, 1033 aa, Glycine max
MEASAGLVAGSHNRNELVVIHGHEEHKPLKNLDGQVCEICGDDVGLTVDGDLFVACNECGFPACRPCYEYERREGRQVCPQCKTRYKRLKGSPRVEGDDEEEDVDDIEHEFNIEEQKKHNHSAEAMLHGKMSYGRGPEDDENAQFPAVIAGGRSRPVSGEFPIASHYGDQMLASSLQNRVHPYPASDPRNGKWDEAKEDRMDDWKLQQGNLGPEPDEDPDAAMLDEARQPLSRKVPIASSKVNPYRMVIVARLVILAFFLRYRLMNPVHDALGLWLTSIICEIWFAFSWILDQFPKWYPIDRETYLDRLSIRYEREGEPNMLAPVDVFVSTVDPMKEPPLVTANTVLSILAMDYPVAKISCYISDDGASMCTFEALSETAEFARKWVPFCKKFSIEPRAPEMYFSEKIDYLKDKVQPTFVKERRAMKREYEEFKVRINALVAKAQKVPQGGWIMQDGTPWPGNNTKDHPGMIQVFLGHSGGHDTEGNELPRLVYVSREKRPGFQHHKKAGAMNALIRVSAVLTNAPFMLNLDCDHYVNNSKAAREAMCFLMDPQTGKKVCYVQFPQRFDGIDRHDRYANRNTVFFDINMKGLDGIQGPAYVGTGCVFRRQALYGYNPPKGPKRPKMVSCDCCPCFGKRKKVKYEGNDANGEAASLRGVDDDKEVLMSQMNFEKKFGQSSIFVTSTLMEEGGVPPSASSASQLKEAIHVISCGYEDKTEWGIELGWIYGSITEDILTGFKMHCRGWRSIYCMPKRAAFKGTAPINLSDRLNQVLRWALGSIEIFFSRHCPLWYGYKEGKLKWLERFAYANTTVYPFTSIPLVAYCVLPAVCLLTDKFIMPPISTFAGLYFVALFSSIIATGLLELKWSGVSIEEWWRNEQFWVIGGVSAHLFAVIQGLLKVLAGIDTNFTVTSKAADDEEFGELYTFKWTTLLIPPTTILIINIVGVVAGISDAINNGYQSWGPLFGKLFFSFWVIVHLYPFLKGLMGRQNRTPTIVVIWSVLLASIFSLLWVRIDPFVLKTKGPDTKLCGINC

SEQ ID NO: 41 - protein, 1080 aa, Glycine max
MESEGEAGAKPVTALGAQVCQICSDGVGKTVDGEPFVACDVCAFPVCRPCYEYERKDGNQSCPQCKTRYKRHKGSPAILGDMEEDGAPAADGASDFNYDSENQNQNQNQKQKISERMLSWQLTYSRGEEVGAPNYDKDVSHNHIPLLTSGQEVSGELSAASPERLSMASPAVGGGKRVHNIPYSSDINQSPNIRAGDPGLGNVAWKERVDGWKMKQEKNVVPMSTGLAASERGAGDVDASTDVLVDDSLLNDEARQPLSRKVSIPSSRINPYRMVIMLRLVILCIFLHYRITNPVPNAYPLWLVSVICEIWFAISWILDQFPKWLPVNRETYLDRLALRYDQEGEPSQLAAVDIFVSTVDPLKEPPLVTANTVLSILAVDYPVDKVSCYVSDDGAAMLTFEALAETSEFARKWVPFSKKYSIEPRAPEWYFAQKIDYLKDKVHPSFVKDRRAMKREYEEFKVRVNGLVAKAQKVPEEGWVMQDGTPWPGNNIRDHPGMIQVFLGQSGGLDTEGNELPRLVYVSREKRPGFQHHKKAGAMNALVRVSAVLTNGPFLLNLDCDHYINNSKALREAMCFMMDPNLGKHVCYVQFPQRFDGIDRNDRYANRNTVFFDINLRGLDGIQGPVYVGTGCVFNRTALYGYEPPLKPKHKKPGLLSSLCGGNRKKSSKSSKKGTDKKKSNKHVDPTVPIFNLEDIEEGVEGTGFDDEKSLLMSQMSLEKRFGQSAVFVASTLMENGGVPQSATPETLLKEAIHVISCGYEDKTDWGSEIGWIYGSVTEDILTGFKMHARGWRSIYCMPKRPAFKGSAPINLSDRLNQVLRWALGSVEILFSRHCPIWYGYGGRLKWLERFAYVNTTIYPVTAIPLLIYCILPAVCLLTNKFIIPQISNLASIWFISLFLSIFATGILEMRWSGVGIDEWWRNEQFWVIGGVSAHLFAVFQGLLKVLAGIDTNFTVTSKASDEDGDFAELYMFKWTTLLIPPTTLLIINMIGVVAGISYAINSGYQSWGPLFGKLFFAFWVIIHLYPFLKGLMGRQNRTPTIVVVWSILLASIFSLLWVRIDPFTTRVTGPDVEECGINC

SEQ ID NO: 42 - protein, 958 aa, Glycine max
MVQSSVPLCNTCGEQVGLNANGEVFVACHECNFPICKDCFEHEINEDHRVCMRCGTPHEERTKEEEEDFHEIKVHENEDDDFHEIKVHENQSTTPFQINNSQDVGLHARHVSTVSTVDSVESWKEKDKKNKKKKAAPKEEKDASIPPEQQMEETRPTEAAAAAPLSVVIPMSKSKIAPYRTVIIMRLIILGLFFHYRVTNPVESAFPLWLTSIICEIWFAFSWVLDQFPKWSPINRQTFIDNLSARFEREGEPNELAAVDFFVSTVDPLKEPPLITANTVLSILAVDYPVDKVSCYVSDDGAAMLTFESLVETADFARKWVPFCKKFSIEPRAPEFYFSQKIDYLKDKVQPSFVKEPRAMRDYEEYKVRVNAMVAKAQKTPEEGWTMQDGTPWPGNNSRDHPGMIQVFLGHTGARDIEGNELPRLVYVSREKRPGYQHHKKAGAENALVRVSAVLTNAPFILNLDCDHYVNNSKAVREAMCFLMDPEVGRDVCYVQFPQRFDGIDRSDRYANRNTVFFDVNMKGLDGIQGPVYVGTGCVFNRQALYGYSPPSMPSLPRSSCCCFPSKKSTNDVSDFQRNAKREELEAAIFNLKELDNYDEHERSMLISQMSFEKTFGLSTVFIESTLMENGGVPEAADPSMLIKEAIHVISCGYEEKTLWGKEIGWIYGSVTEDILSGFKMQCRGWKSIYCMPLRPAFKGSAPINLSDRLHQVLRWALGSIEIFLSRHCPLWYGFSGGRLKWLQRMAYINTIVYPFTSLPLVAYCSLPAICLLTGKFIIPTLSNVASVLFLGLFLSIIITSVLELRWSGVSIEDLWRNEQFWVIGGVSAHLFAVFQGLLKMLAGVDTNFTWTTLLIPPTTLIIVNMVGVVAGFSDALNGGYESWGPLFGKVFFAFWVIFHLYPFLKGLMGRQNRTPTIVVLWSVLLASVFSLVWVKINPFVNTVDSETIAETCIAIDC

SEQ ID NO: 43 - protein, 1097 aa, Glycine max
MHTGGRLVAGSHNRNEFVLINADDNGRIKSVRELSGQICQICGDEIEITVDGEPFVACNECAFPVCRPCYEYERREGIQACPQCNTRYKRIKGSPRVEGDEEEDDTDDLDNEFDYGDVDALGPQPMSESLYSGRPNTGRGANNGSGMATNLEHGSAPQNSDIPLLTYGEEDPEISSNSHALIVPSHMNHGNRVHPMPYNDPSIPLQPRPMAPKKDIAVYGYGSVAWKDRMEEWKKRQSDKLQVVKHEGSNDGNFGDDFEDSDLPMMDEGRQPLSRKLPIPSSKINPYRMIIVLRLVVLGLFFHYRILHPVNDAYGLWLTSVICEIWFAVSWIMDQFPKWYPIQRETYLDRLSLRYEKEGKPSELSSVDVFVSTVDPMKEPPLITANTVLSILAVDYPVDKVACYVSDDGAAMLTFEALSETSEFARRWVPFCKKYNIEPRAPEWYFGQKMDYLKNKVHPAFVRERRAMKRDYEEFKVRINSLVATAQKVPEDGWTMQDGTPWPGNNVRDHPGMIQVFLGQDGVRDVEGNELPRLVYVSREKRPGFDHHKKAGAMNALVRASAIITNAPYLLNVDCDHYINNSKALREAMCFMMDPQLGKKVCYVQFPQRFDGIDRHDRYSNRNVVFFDINMKGLDGIQGPIYVGTGCVFRRYALYGYDAPAKKKPPSKTCNCWPKWCCLCCGSRKKKNANTKKEKKRKVKHSEASKQIHALENIEAGNEGTNNEKTSNLTQTKLEKRFGQSPVFVASTLLDNGGVPQGVSPASLLKEAIQVISCGYEDKTEWGKEVGWIYGSVTEDILTGFKMHCHGWRSVYCIPKRPAFKGSAPINLSDRLHQVLRWALGSVEIFFSRHCPIWYGYGGGLKWLERFSYINSVVYPWTSLPLLVYCTLPAICLLTGKFIVPEISNYASIVFMALFISIAATGILEMQWGGVSIDDWWRNEQFWVIGGVSSHLFALFQGLLKVLAGVNTNFTVTSKAADDGEFSELYIFKWTSLLIPPMTLLIMNIVGVVVGVSDAINNGYDSWGPLFGRLFFALWVILHLYPFLKGLLGKQDRMPTIILVWSILLASILTLMWVRINPFVSRDGPVLEICGLNCDES

SEQ ID NO: 44 - protein, 1073 aa, Glycine max
MTESEEAGAKPMNTLGGQVCQICGDNIGNNVNGDPFIACDVCAFPVCRACYEYERKDGNQSCPQCKTRYKRHKGSPAILGDQEEDGGADEGASDLNYNSENQNEKQKIERMLGWQMAHGRAEEAVAPNYDKEVSHNHIPLLSGGQEVSGELSAASPERLSMASPGGRGKRVHNLQYSSDLNQSPNIRVGDPGLGNVAWKERVDGWKMKQDKNVAPMSTGQATSERGAGDIDASTDVLVDDSLLNDEARQPLSRKVSIPSSRINPYRMVIALRLVILCIFLHYRITNPVPNAYALWLISVICEIWFAISWIFDQFPKWLPVNRETYLDRLALRYDQEGEPSQLAAVDIFVSTVDPLKEPPLVTANTVLSILSVDYPVDKVSCYVSDDGAAMLTFEALAETSEFARKWVPFSKKYNIEPRAPEWYFAQKIDYLKDKVQPSFVKDRRAMKREYEEFKIRVNGLVAKAQKVPEEGWVMQDGTPWPGNNTRDHPGMIQVFLGQSGGLDTEGNELPRLVYVSREKRPGFQHHKKAGAMNALVRVSAVLTNGPFLLNLDCDHYINNSKALREAMCFMMDPNLGKNVCYVQFPQRFDGIDRNDRYANRNTVFFDINLRGLDGIQGPVYVGTGCVFNRTALYGYEPPIKPKHKKPGLLSSLCGGNRKKRSKSSKKGSDKKKSSKNVDPTVPIFSLEDIEEGVEGAGFDDEKSLLMSQMSLEKRFGQSAVFVASTLMENGGVPQSATPETLLKEAIHVISCGYEDKTEWGSEIGWIYGSVTEDILTGFKMHARGWRSIYCMPKLPAFKGSAPINLSDRLNQVLRWALGSVEILFSRHCPIWYGYSGRLKWLERFAYVNTTIYPVTSIPLLMYCTLPAVCLLTNKFIIPQISNIASIWFISLFLSIFATGILEMRWSGVGIDEWWRNEQFWVIGGVSAHLFAVFQGLLKVLAGIDTNFTVTSKASDEDGDFAELYLFKWTTLLIPPTTLLIINLVGVVAGISYAINSGYQSWGPLFGKLFFAFWVIIHLYPFLKGLMGRQNRTPTIVVVWSILLASIFSLLWVRIDPFTTRVTGPDVEQCGINC

SEQ ID NO: 45 - protein, 1074 aa, Glycine max
MMESEGEAGAKPMKTLGGKICQICGDNIGNNANGDPFIACDVCAFPVCRACYEYERKDGNQSCPQCKTRYKRHKGSPAILGDREEDGGADDGASDFNYNSENQNEKQKIEHMLGWQMAYGRAEEAIAPNYDKEVSHNHIPLLSGGQEVSGELSAASPERLSMASPGGRGKRAHNLQYSSDLNHSPNIRVGDPGLGNVAWKERVDGWKMKQDKNVAPMSTGQATSERGAGDIDASTDVLVDDSLLNDEARQPLSRKVSIPSSRINPYRMVIALRLVILCIFLHYRITNPVPNAYALWLISVICEIWFAISWILDQFPKWLPVNRETYLDRLALRYDREGEPSQLAAVDIFVSTVDPLKEPPLVTANTVLSILSVDYPVDKVSCYVSDDGAAMLTFEALAETSEFARKWVPFSKKYNIEPRAPEWYFAQKIDYLKDKVQPSFVKDRRAMKREYEEFKIRINGLVAKAQKIPEEGWVMQDGTPWPGNNTRDHPGMIQVFLGQSGGLDTEGNELPRLVYVSREKRPGFQHHKKAGAMNALVRVSAVLTNGPFLLNLDCDHYINNSKALREAMCFMMDPNLGKNVCYVQFPQRFDGIDRNDRYANRNTVFFDINLRGLDGIQGPVYVGTGCVFNRTALYGYEPPIKPKHKKPGFLSSLCGGNRKKRSKSSKKGSDKKKSSKNVDPTVPIFSLEDIEEGVEGAGFDDEKSLLMSQMSLEKRFGQSAVFVASTLMENGGVPQSATPETLLKEAIHVISCGYEDKSEWGSEIGWIYGSVTEDILTGFKMHARGWRSIYCMPKLPAFKGSAPINLSDRLNQVLRWALGSVEILFSRHCPIWYGYSGRLKWLERFAYVNTTIYPVTSIPLLMYCTLPAVCLLTNKFIIPQISNIASIWFISLFLSIFATGILEMRWSGVGIDEWWRNEQFWVIGGVSAHLFAVFQGLLKVLAGIDTNFTVTSKASDEDGDFAELYMFKWTTLLIPPTTLLIINLVGVVAGISYAINSGYQSWGPLFGKLFFAFWVIIHLYPFLKGLMGRQNRTPTIVVVWSILLASIFSLLWVRIDPFTTRVTGPDVEQCGINC

SEQ ID NO: 46 - protein, 1095 aa, Glycine max
MDTKGRLVAGSHNRNEFVLINADETARVNAVTELSGQICQICGDEIEVTVDGEPFVACNECAFPVCRPCYEYERREGNKICPQCKTIYKRLKGSPRVEGDEEEEDIDDLENEFDIGSNIRHDPHHVAEALLSARLNAARGSQMNAPGITTPSEFDAASVAADIPLLTYDHEDVGISADKHALIIPPFMHHGKRVHPMPPDSSVPVQPRPMDPKKDLAVYGYGSVAWKERMEEWKKRQNEKIEVVKHEGGNDGGKNGDELDDPDLPKMDEGRQPLWRKLPISPSKINPYRIIIVLRIAVLGLFFHYRILHPVNDAYALWLTSVICEIWFAVSWILDQFPKWCPIERETYLDRLSSRYEKEGKPSELADIDVFVSTVDPMKEPPLITANTVLSILAVDYPVEKVSCYVSDDGAAMLTFEAISETSEFARKWVPFCKKFNIEPRAPEWYFAQKVDYLKDKVDATFIRERRAIKREYEEFKVRINALVAMAQKVPEDGWTMQDGTPWPGNSVRDHPGMIQVFLGQNGIHNIEGNELPRLVYVSREKRPGYEHHKKAGAMNALVRVSAVISNAPYLLNVDCDHYINNSKALREAMCFMMDPTSGKKICYVQFPQRFDGIDRHDRYSNRNVVFFDINMKGLDGIQGPIYVGTGCVFRRQALYGYDAPATKKPPRKTCNCWPKWCCLCCGSRNKNRKVKSGPRKKIKNKDATKQIHALENIEEGIEGIDSEKSWLMSQLKFEKKFGQSAVFIASTLMEDGGILKGATSASLLKEAIHVISCGYEDKTEWGKEVGWIYGSVTEDILTGFKMHCHGWRSVYCMPKRPAFKGSAPINLSDRLHQVLRWALGSVEILLSKHCPIWYGYGCGLKWLERFSYINSVIYPLTSLPLIAYCTLPAVCLLTGKFIVPEISNYASIIFMALFISIAVTSILEMQWGGVGIHDWWRNEQFWVIGGASSHLFALFQGLLKVLAGVNTNFTVTSKAADGGDFAELYLFKWTSLLIPPLTLLIINIIGVIVGVSDAINNGYDSWGPLFGKLFFALWVIVHLYPFLKGVMGKQEGVPTIILVWAILLASIFSLLWVRINPFLSKGGIVLELCGLNCD

SEQ ID NO: 47 - protein, 1078 aa, Glycine max
MDTKGRLVAGSHNRNEFVLINADETARVAVTELSGQICQICGDELEVTVNGEPFVACNECAFPVCRPCYEYERREGNQVCPQCKTRYKRIKGSPRVEGDEEEDDTDDLESEFDIGSVFSARLNYGSQVNGSVIHAPSEFDAASVASEIPLLTYGQEDVGISADKHALILPPFTARGKRVYPMPFPDSSVPVQPRPMDPKKDIAVYGYGSVAWKERMEDWKKKQSEKLQVVRHEGDKDSDELDDPDLPKMDEGRQPLWRKLPISSSRINPYRIIIVLRIAILCLFFHYRILHPVNDAYALWLTSVICEIWFAVSWIFDQFPKWSPILRETYLDRLSLRYEKEGKPSQLSDIDVFVSTVDPMKEPPLITANTVLSILAVDYPVDKVACYVSDDGAAMLTFEALSETSEFARKWVPFCKKFCIEPRAPEWYFAQKVDYLKDKVDATFIRERRAIKREYEEFKVRINALVALAQKVPEDGWTMQDGTPWPGNNVRDHPGMIQVFLGQNGVRDIEGNELPRLVYVSREKRPGYDHHKKAGAMNALVRVSAIITNAPYVLNVDCDHYINNSKALREAMCFMMDPTSGKKICYVQFPQRFDGIDRHDRYSNRNVVFFDINMKGLDGIQGPIYVGTGCVFRRQAFYGCDAPTSKKAPRKTCNCWPKWCCCLCCGSRKKKIKAKSSVKKKIKNKDDLKQMHALENIEEGIEGIDNEKSSLMSQSKFEKKFGQSSVFIASTLLEDGGVPKAASSATLLKEAIHVISCGYEDKTEWGKEVGWIYGSVTEDILTGFKMHCHGWRSVYCMPKRPAFKGSAPINLSDRLHQVLRWALGSVEIFFSRHCPIWYGYGGGLKSLERFSYINSVVYPLTSIPLIAYCALPAVCLLTGKFIVPEISNYASIIFMALFISIAATGILEMQWGGVGIHDWWRNEQFWVIGGASSHLFALFQGLLKVLAGVNTNFTVTSKAADDGEFAELYIFKWTSLLIPPLTLLILNIIGVIVGVSDAINNGYDSWGPLFGRLFFALWVIVHLYPFLKGVMGKQEGVPTIILVWAILLASILTLLWVRINPFLAKNDVVLEICGLNCD

SEQ ID NO: 48 - protein, 989 aa, Oryza sativa
MMESGVPPCAACGDDAHAACRACSYALCKACLDEDAAEGRTTCARCGGEYGAPDPAHGQGAVVEEEVEESHEPAAGGVRERVTMASQLSDHQDEGVHARTMSTHARTISSVSGVGSELNDESGKPIWKNRVESWKEKKKEKKASAKKAAAKAQAPPVEEQIMDEKDLTDAYEPLSRIIPISKNKLTPYRAVIIMRLVVLGLFFHYRITNPVYSAFGLWMTSVICEIWFGFSWILDQFPKWCPINRETYVDRLIARYGDGEDSGLAPVDFFVSTVDPLKEPPLITANTVLSILAVDYPVEKISCYVSDDGSAMLTFESLAETAEFARRWVPFCKKYSIEPRAPEFYFSQKIDYLKDKIHPSFVKERRAMKRDYEEYKVRINALVAKAQKTPEEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPSVGRDVCYVQFPQRFDGIDRSDRYANRNVVFFDVNMKGLDGLQGPVYVGTGCCFYRQALYGYGPPSLPALPKSSVCSWCCCCCPKKKAEKSEKEMHRDSRREDLESAIFNLREIDNYDEYERSMLISQMSFEKSFGLSSVFIESTLMENGGVPESANPSTLIKEAIHVISCGYEEKTEWGKEIGWIYGSVTEDILTGFKMHCRGWRSIYCMPIRPAFKGSAPINLSDRLHQVLRWALGSVEIFLSRHCPLWYGYGGGRLKWLQRLSYINTIVYPFTSLPLIAYCCLPAICLLTGKFIIPTLSNAATIWFLGLFISIIVTSVLELRWSGIGIEDWWRNEQFWVIGGVSAHLFAVFQGILKMIAGLDTNFTVTAKATDDTEFGELYVFKWTTVLIPPTSILVLNLVGVVAGFSDALNSGYESWGPLFGKVFFAMWVIMHLYPFLKGLMGRQNRTPTIVVLWSVLLASVFSLLWVKIDPFIGSSETTTTNSCANFDC

SEQ ID NO: 49 - protein, 1073 aa, Oryza sativa
MDGAKSGKQCHVCQICGDGVGTAADGELFTACDVCGFPVCRPCYEYERKDGSQACPQCKTKYKRHKGSPPILGDESDDVDADDASDVNYPTSGNQDHKHKIAERMLTWRMNSGRNDDIVHSKYDSGEIGHPKYDSGEIPRIYIPSLTHSQISGEIPGASPDHMMSPVGNIGRRGHPFPYVNHSPNPSREFSGSLGNVAWKERVDGWKMKDKGAIPMANGTSIAPSEGRGVGDIDASTDYNMEDALLNDETRQPLSRKVPISSSRINPYRMVIVLRLIVLCIFLHYRITNPVRNAYPLWLLSVICEIWFALSWILDQFPKWSPINRETYLDRLALRYDREGEPSQLAPVDIFVSTVDPMKEPPLVTANTVLSILAVDYPVDKVSCYVSDDGAAMLTFDALAETSEFARKWVPFCKKYSIEPRAPEWYFAQKIDYLKDKVQASFVKDRRAMKREYEEFKVRVNALVAKAQKVPEEGWIMQDGTPWPGNNTRDHPGMIQVFLGHSGGLDTEGNELPRLVYVSREKRPGFQHHKKAGAMNALVRVSAVLTNGQYLLNLDCDHYINNSKALREAMCFLMDPNLGRRVCYVQFPQRFDGIDRNDRYANRNTVFFDINLRGLDGLQGPVYVGTGCVFNRTALYGYEPPIKQKRPGYFSSLCGGRKKTKKSKEKSTEKKKSHKHVDSSVPVFNLEDIEEGIEGSGFDDEKSLLMSQMSLEKRFGQSSVFVASTLMEYGGVPQSATPESLLKEAIHVISCGYEDKSDWGTEIGWIYGSVTEDILTGFKMHARGWRSIYCMPKRPAFKGSAPINLSDRLNQVLRWALGSVEILFSRHCPIWYGYGGRLKFLERFAYINTTIYPLTSIPLLLYCILPAICLLTGKFIIPEISNFASIWFISLFLSIFATGILEMRWSGVGIDEWWRNEQFWVIGGISAHLFAVFQGLLKVLAGIDTSFTVTSKASDEEGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQKCGINC

SEQ ID NO: 50 - protein, 1092 aa, Oryza sativa
MEASAGLVAGSHNRNELVVIRRDGEPGPKPVKHTNGQVCQICGDDVGLTPDGEPFVACNECAFPVCRDCYEYERREGTQNCPQCKTRFKRLKGCARVPGDEEEEDVDDLENEFNWRDKTDSQYVAESMLHGHMSYGRGGDLDGVPQHFQPIPNVPLLTNGEMADDIPPEQHALVPSFMGGGGKRIHPLPYADPNLPVQPRSMDPSKDLAAYGYGSVAWKERMESWKQKQERLHQMRNDGGGKDWDGDGDDADLPLMDEARQPLSRKIPISSSLVNPYRMIIIIRLVVLGFFFHYRVMHPVPDAFALWLISVICEIWFAMSWILDQFPKWFPIERETYLDRLTLRFDKEGQQSQLAPVDFFVSTVDPMKEPPLVTANTVLSILAVDYPVDKVSCYVSDDGAAMLTFEALSETSEFAKKWVPFCKRYSLEPRAPEWYFQQKIDYLKDKVAPNFVRERRAMKREYEEFKVRINALVAKAQKVPEEGWTMQDGTPWPGNNVRDHPGMIQVFLGQSGGHDVEGNELPRLVYVSREKRPGYNHHKKAGAMNALVRVSAVLTNAPYMLNLDCDHYINNSKAIKEAMCFMMDPLVGKKVCYVQFPQRFDGIDRHDRYANRNVVFFDINMKGLDGIQGPIYVGTGCVFRRQALYGYDAPKSKKPPSRTCNCWPKWCICCCCFGNRTNKKKTAKPKTEKKKRLFFKRAENQSPAYALGEIDEGAPGAENEKAGIVNQQKLEKKFGQSSVFVASTLLENGGTLKSASPASLLKEAIHVISCGYEDKTDWGKEIGWIYGSVTEDILTGFKMHCHGWRSIYCIPKRAAFKGSAPLNLSDRLHQVLRWALGSIEIFFSNHCPLWYGYGGGLKCLERFSYINSIVYPWTSIPLLAYCTLPAICLLTGKFITPELTNIASLWFMSLFICIFATGILEMRWSGVGIDDWWRNEQFWVIGGVSSHLFAVFQGLLKVIAGIDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKNDGPLLEECGLDCN

SEQ ID NO: 51 - protein, 1076 aa, Oryza sativa
MAANAGMVAGSRNRNEFVMIRPDGDAPPPAKPGKSVNGQVCQICGDTVGVSATGDVFVACNECAFPVCRPCYEYERKEGNQCCPQCKTRYKRHKGSPRVQGDEEEEDVDDLDNEFNYKHGNGKGPEWQIQRQGEDVDLSSSSRHEQHRIPRLTSGQQISGEIPDASPDRHSIRSGTSSYVDPSVPVPVRIVDPSKDLNSYGINSVDWQERVASWRNKQDKNMMQVANKYPEARGGDMEGTGSNGEDMQMVDDARLPLSRIVPIPSNQLNLYRIVIILRLIILMFFFQYRVTHPVRDAYGLWLVSVICEIWFALSWLLDQFPKWYPINRETYLDRLALRYDREGEPSQLAPIDVFVSTVDPLKEPPLITANTVLSILAVDYPVDKVSCYVSDDGSAMLTFEALSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVVKSCCGGRKKKSKSYMDSKNRMMKRTESSAPIFNMEDIEEGIEGYEDERSVLMSQKRLEKRFGQSPIFIASTFMTQGGIPPSTNPASLLKEAIHVISCGYEDKTEWGKEIGWIYGSVTEDILTGFKMHARGWISIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAVALGQCGVNC

SEQ ID NO: 52 - protein, 1170 aa, Oryza sativa
MASSGGGGLRHSNSSRLSRMSYSGEDGRAQAPGGGGDRPMVTFARRTHSGRYVSYSRDDLDSELGNSGDMSPESGQEFLNYHVTIPATPDNQPMDPAISARVEEQYVSNSLFTGGFNSVTRAHLMDKVIESEASHPQMAGAKGSSCAINGCDAKVMSDERGDDILPCECDFKICADCFADAVKNGGACPGCKDPYKATELDDVVGARPTLSLPPPPGGLPASRMERRLSIMRSQKAMTRSQTGDWDHNRWLFETKGTYGYGNAIWPKENEVDNGGGGGGGGGLGGGDGQPAEFTSKPWRPLTRKLKIPAGVLSPYRLLILIRMAVLGLFLAWRIKHKNEDAMWLWGMSVVCELWFGLSWLLDQLPKLCPVNRATDLAVLKDKFETPTPSNPNGRSDLPGLDIFVSTADPEKEPPLVTANTILSILAADYPVEKLSCYVSDDGGALLTFEAMAEAASFANMWVPFCRKHDIEPRNPESYFNLKRDPYKNKVRSDFVKDRRRVKREYDEFKVRINSLPDSIRRRSDAYHAREEIKAMKRQREAALDDVVEAVKIPKATWMADGTHWPGTWIQPSAEHARGDHAGIIQVMLKPPSDDPLYGTSGEEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGIMGPVYVGTGCLFRRIALYGFDPPRSKEHSGCCSCCFPQRRKVKTSTVASEERQALRMADFDDEEMNMSQFPKKFGNSNFLINSIPIAEFQGRPLADHPGVKNGRPPGALTVPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASRKMKFLQRIAYLNVGIYPFTSIFLIVYCFLPALSLFSGQFIVRTLNVTFLTYLLVITLTMCMLAVLEIKWSGISLEEWWRNEQFWLIGGTSAHLAAVLQGLLKVIAGIEISFTLTSKSGGDEADDEFADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFTFP

SEQ ID NO: 53 - protein, 1012 aa, Oryza sativa
MSVDYANYTVLMPPTPDNQPSGGAPPAAPSAGGARPGDLPLPPYGSSSSSRLVNRRGGGDDGAKMDRRLSTARVPAPSSNKSLLVRSQTGDFDHNRWLFETKGTYGIGNAYWPQDNVYGDDGGGGAVKMEDLVEKPWKPLSRKVPIPPGILSPYRLLVLVRFVALFLFLVWRVTNPNMDALWLWGISIVCEFWFAFSWLLDQMPKLNPINRAADLAALKEKFESPSPTNPTGRSDLPGLDVFISTADPYKEPTLVTANTLLSILATEYPVEKLFVYISDDGGALLTFESMAEACAFAKVWVPFCRKHSIEPRNPDSYFTQKGDPTKGKKRPDFVKDRRWIKREYDEFKIRVNSLPDLIRRRANALNARERKLARDKQAAGDADALASVKAATWMADGTHWPGTWLDPSPDHAKGDHASIVQVMIKNPHHDVVYGEAGDHPYLDMTDVDMRIPMFAYLSREKRAGYDHNKKAGAMNAMVRASAILSNGPFMLNFDCDHYIYNCQAIREAMCYMLDRGGDRICYIQFPQRFEGIDPSDRYANHNTVFFDGNMRALDGLQGPMYVGTGCLFRRYAIYGFNPPRAIEYRGTYGQTKVPIDPRQGSEAMPGAGGGRSGGGSVGGDHELQALSTAHPDHEAPQKFGKSKMFIESIAVAEYQGRPLQDHPSVLNGRPPGALLMPRPPLDAATVAESVSVISCWYEDNTEWGQRVGWIYGSVTEDVVTGYRMHNRGWRSVYCITRRDAFRGTAPINLTDRLHQVLRWATGSVEIFFSKNNAVLASRRLKFLQRMAYLNVGIYPFTSLFLIMYCLLPALSLFSGQFIVATLDPTFLSYLLLITITLMLLCLLEVKWSGIGLEEWWRNEQFWVIGGTSAHLAAVLQGLLKVVAGIEISFTLTAKAAAEDDDDPFAELYLIKWTSLFIPPLAVIGINIIALVVGVSRTVYAEIPQYSKLLGGGFFSFWVLAHYYPFAKGLMGRRGRTPTIVYVWAGLISITVSLLWITISPPDDSVAQGGIDV

SEQ ID NO: 54 - protein, 860 aa, Oryza sativa
MDGESPEIMPVECPDPEPASSESGDDHDIPEPLSSRLSVPSGELNLYRAAVALRLVLLAAFFRYRVTRPVADAHALWVTSVACELWLAASWLIAQLPKLSPANRVTYLDRLASRYEKGGEASRLAGVDVFVAAADAAREPPLATANTVLSVLAADYPAGGVACYVHDDGADMLVFESLFEAAGFARRWIPFCRRHGVEPRAPELYFARGVDYLRDRAAPSFVKDRRAMKREYEEFKVRMNHLAARARKVPEEGWIMSDGTPWPGNNSRDHPAMIQVLLGHPGDRDVDGGELPRLFYVSREKRPGFRHHGKAGAMNALLRVSAVLTNGAYVLNLDCDHCVNNSSALREAMCFMMDPVAGNRTCFVQFALRDSGGGDSVFFDIEMKCLDGIQGPVYVGSGCCFSRKALYGFEPAAAADDGDDMDTAADWRRMCCFGRGKRMNAMRRSMSAVPLLDSEDDSDEQEEEEAAGRRRRLRAYRAALERHFGQSPAFIASAFEEQGRRRGGDGGSPDATVAPARSLLKEAIHVVSCAFEERTRWGKEIGWMYGGGVATGFRMHARGWSSAYCSPARPAFRRYARASPADVLAGASRRAVAAMGILLSRRHSPVWAGRRLGLLQRLGYVARASYPLASLPLTVYCALPAVCLLTGKSTFPSDVSYYDGVLLILLLFSVAASVALELRWSRVPLRAWWRDEKLWMVTATSASLAAVFQGILSACTGIDVAFSTETAASPPKRPAAGNDDGEEEAALASEITMRWTNLLVAPTSVVVANLAGVVAAVAYGVDHGYYQSWGALGAKLALAGWVVAHLQGFLRGLLAPRDRAPPTIAVLWSVVFVSVASLLWVHAASFSAPTAAPTTEQPIL

SEQ ID NO: 55 - protein, 1081 aa, Oryza sativa
MDGDADAVKSGRHGSGQACQICGDGVGTTAEGDVFAACDVCGFPVCRPCYEYERKDGTQACPQCKTKYKRHKGSPAIRGEEGEDTDADDVSDYNYPASGSADQKQKIADRMRSWRMNAGGGGDVGRPKYDSGEIGLTKYDSGEIPRGYIPSVTNSQISGEIPGASPDHHMMSPTGNIGKRAPFPYVNHSPNPSREFSGSIGNVAWKERVDGWKLKQDKGAIPMTNGTSIAPSEGRGVGDIDASTDYNMEDALLNDETRQPLSRKVPLPSSRINPYRMVIVLRLVVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRINGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKKGSFLSSLCGGRKKASKSKKKSSDKKKSNKHVDSAVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPIWYGYGGRLKFLERFAYINTTIYPLTSIPLLIYCVLPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 56 - protein, 1092 aa, Oryza sativa
MEASAGLVAGSHNRNELVVIRRDGGGGGGVGGRRAAEAKAACQICGDDVGEGPDGEPFVACNECAFPVCRNCYDYERREGSQACPQCKTRFKRLKGCPRVAGDEEEDGVDDLEGEFGLDGREDDPQYIAESMLRANMSYGRGGDLQPFQPIPNVPLLTNGQMVDDIPPEQHALVPSYMGGGGGGGKRIHPLPFADPSVPVQPRSMDPSKDLAAYGYGSVAWKERMEGWKQKQERMQQLRSEGGGDWDGDGDADLPLMDEARQPLSRKVPISSSRINPYRMIIIIRLVVLGFFFHYRVMHPVNDAFALWLISVICEIWFAMSWILDQFPKWLPIERETYLDRLSLRFDKEGQPSQLAPVDFFVSTVDPSKEPPLVTANTVLSILSVDYPVEKVSCYVSDDGAAMLTFEALSETSEFAKKWVPFCKKFNIEPRAPEWYFQQKIDYLKDKVAASFVRERRAMKRDYEEFKVRINALVAKAQKVPEEGWTMQDGSPWPGNNVRDHPGMIQVFLGQSGGRDVEGNELPRLVYVSREKRPGYNHHKKAGAMNALVRVSAVLSNAPYLLNLDCDHYINNSKAIREAMCFMMDPLVGKKVCYVQFPQRFDGIDRHDRYANRNVVFFDINMKGLDGIQGPIYVGTGCVFRRQALYGYDAPKTKKPPSRTCNCWPKWCCCCCCGNRHTKKKTTKPKPEKKKRLFFKKAENQSPAYALGEIEEGAPGAETDKAGIVNQQKLEKKFGQSSVFVASTLLENGGTLKSASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICLLTGKFITPELTNVASLWFMSLFICIFVTGILEMRWSGVAIDDWWRNEQFWVIGGVSSHLFAVFQGLLKVLAGVDTSFTVTSKAGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKNNGPLLEECGLDCN

SEQ ID NO: 57 - protein, 1093 aa, Oryza sativa
MEASAGLVAGSHNRNELVVIRRDGDPGPKPLRQQNGQVCQICGDDVGLNPDGEPFVACNECAFPVCRDCYEYERREGTQNCPQCKTRFKRLRGCARVPGDEEEDGVDDLENEFNWRDRNDSQYVAESMLHAHMSYGRGGVDVNGVPQPFQPNPNVPLLTDGQMVDDIPPEQHALVPSFMGGGGKRIHPLPYADPNLPVQPRSMDPSKDLAAYGYGSVAWKERMESWKQKQERLHQMRNDGGGKDWDGDGDDGDLPLMDEARQPLSRKVPIPSSQINPYRMVIIIRLVVLGFFFHYRVMHPVPDAFALWLISVICEIWFAMSWILDQFPKWFPIERETYLDRLTLRFDKEGQTSQLAPIDFFVSTVDPLKEPPLVTANTVLSILAVDYPVDKVSCYVSDDGAAMLTFEALSETSEFAKKWVPFCKKYSIEPRAPEWYFQQKIDYLKDKVAPYFVRERRAMKREYEEFKVRINALVAKAQKVPEEGWTMQDGTPWPGNNVRDHPGMIQVFLGQSGGHDIEGNELPRLVYVSREKRPGYNHHKKAGAMNALVRVSAVLTNAPYMLNLDCDHYINNSKAIKEAMCFMMDPLVGKKVCYVQFPQRFDGIDRHDRYANRNVVFFDINMKGLDGIQGPIYVGTGCVFRRQALYGYDAPKTKKPPSRTCNCWPKWCICCCCFGDRKSKKKTTKPKTEKKKRSFFKRAENQSPAYALGEIEEGAPGAENEKAGIVNQQKLEKKFGQSSVFVASTLLENGGTLKSASPASLLKEAIHVISCGYEDKTDWGKEIGWIYGSVTEDILTGFKMHCHGWRSIYCIPKLPAFKGSAPLNLSDRLHQVLRWALGSVEIFFSNHCPLWYGYGGGLKCLERFSYINSIVYPFTSIPLLAYCTLPAICLLTGKFITPELTNVASLWFMSLFICIFATGILEMRWSGVGIDDWWRNEQFWVIGGVSSHLFALFQGLLKVIAGIDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKNDGPLLEECGLDCN

SEQ ID NO: 58 - protein, 837 aa, Oryza sativa
MDEARQPLSRKVPIPSSQINPYRMVIIIRLVVLGFFFHYRVMHPVPDAFALWLISVICEIWFAMSWILDQFPKWFPIERETYLDRLTLRFDKEGQTSQLAPIDFFVSTVDPLKEPPLVTANTVLSILAVDYPVDKVSCYVSDDGAAMLTFEALSETSEFAKKWVPFCKKYSIEPRAPEWYFQQKIDYLKDKVAPYFVRERRAMKREYEEFKVRINALVAKAQKVPEEGWTMQDGTPWPGNNVRDHPGMIQVFLGQSGGHDIEGNELPRLVYVSREKRPGYNHHKKAGAMNALVRVSAVLTNAPYMLNLDCDHYINNSKAIKEAMCFMMDPLVGKKVCYVQFPQRFDGIDRHDRYANRNVVFFDINMKGLDGIQGPIYVGTGCVFRRQALYGYDAPKTKKPPSRTCNCWPKWCICCCCFGDRKSKKKTTKPKTEKKKRSFFKRAENQSPAYALGEIEEGAPGAENEKAGIVNQQKLEKKFGQSSVFVASTLLENGGTLKSASPASLLKEAIHVISCGYEDKTDWGKEIGWIYGSVTEDILTGFKMHCHGWRSIYCIPKLPAFKGSAPLNLSDRLHQVLRWALGSVEIFFSNHCPLWYGYGGGLKCLERFSYINSIVYPFTSIPLLAYCTLPAICLLTGKFITPELTNVASLWFMSLFICIFATGILEMRWSGVGIDDWWRNEQFWVIGGVSSHLFALFQGLLKVIAGIDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKNDGPLLEECGLDCN

SEQ ID NO: 59 - protein, 966 aa, Oryza sativa
MLHAHMSYGRGGVDVNGVPQPFQPNPNVPLLTDGQMVDDIPPEQHALVPSFMGGGGKRIHPLPYADPNLPVQPRSMDPSKDLAAYGYGSVAWKERMESWKQKQERLHQMRNDGGGKDWDGDGDDGDLPLMDEARQPLSRKVPIPSSQINPYRMVIIIRLVVLGFFFHYRVMHPVPDAFALWLISVICEIWFAMSWILDQFPKWFPIERETYLDRLTLRFDKEGQTSQLAPIDFFVSTVDPLKEPPLVTANTVLSILAVDYPVDKVSCYVSDDGAAMLTFEALSETSEFAKKWVPFCKKYSIEPRAPEWYFQQKIDYLKDKVAPYFVRERRAMKREYEEFKVRINALVAKAQKVPEEGWTMQDGTPWPGNNVRDHPGMIQVFLGQSGGHDIEGNELPRLVYVSREKRPGYNHHKKAGAMNALVRVSAVLTNAPYMLNLDCDHYINNSKAIKEAMCFMMDPLVGKKVCYVQFPQRFDGIDRHDRYANRNVVFFDINMKGLDGIQGPIYVGTGCVFRRQALYGYDAPKTKKPPSRTCNCWPKWCICCCCFGDRKSKKKTTKPKTEKKKRSFFKRAENQSPAYALGEIEEGAPGAENEKAGIVNQQKLEKKFGQSSVFVASTLLENGGTLKSASPASLLKEAIHVISCGYEDKTDWGKEIGWIYGSVTEDILTGFKMHCHGWRSIYCIPKLPAFKGSAPLNLSDRLHQVLRWALGSVEIFFSNHCPLWYGYGGGLKCLERFSYINSIVYPFTSIPLLAYCTLPAICLLTGKFITPELTNVASLWFMSLFICIFATGILEMRWSGVGIDDWWRNEQFWVIGGVSSHLFALFQGLLKVIAGIDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKNDGPLLEECGLDCN

SEQ ID NO: 60 - protein, 1115 aa, Oryza sativa
MSTGPGKKAIRNAGGVGGGAGPSAGGPRGPAGQAVKFARRTSSGRYVSLSREDIDMEGELAADYTNYTVQIPPTPDNQPMLNGAEPASVAMKAEEQYVSNSLFTGGFNSATRAHLMDKVIESSVSHPQMAGAKGSRCAMPACDGSAMRNERGEDVDPCECHFKICRDCYLDAQKDGCICPGCKEHYKIGEYADDDPHDGKLHLPGPGGGGNKSLLARNQNGEFDHNRWLFESSGTYGYGNAFWPKGGMYDDDLDDDVDKLGGDGGGGGGGGPLPEQKPFKPLTRKIPMPTSVISPYRIFIVIRMFVLLFYLTWRIRNPNMEALWLWGMSIVCELWFAFSWLLDMLPKVNPVNRSTDLAVLKEKFETPSPSNPHGRSDLPGLDVFVSTADPEKEPVLTTATTILSILAVDYPVEKLACYVSDDGGALLTFEAMAEAASFANVWVPFCKKHDIEPRNPDSYFSVKGDPTKGKRRNDFVKDRRRVKREFDEFKVRINGLPDSIRRRSDAFNAREDMKMLKHLRETGADPSEQPKVKKATWMADGSHWPGTWAASAPDHAKGNHAGILQVMLKPPSPDPLYGMHDDDQMIDFSDVDIRLPMLVYMSREKRPGYDHNKKAGAMNALVRCSAVMSNGPFMLNFDCDHYINNAQAVREAMCFFMDRGGERIAYIQFPQRFEGIDPSDRYANNNTVFFDGNMRALDGLQGPMYVGTGCMFRRFAVYGFDPPRTAEYTGWLFTKKKVTTFKDPESDTQTLKAEDFDAELTSHLVPRRFGNSSPFMASIPVAEFQARPLADHPAVLHGRPSGALTVPRPPLDPPTVAEAVSVISCWYEDKTEWGDRVGWIYGSVTEDVVTGYRMHNRGWRSVYCITKRDAFLGTAPINLTDRLHQVLRWATGSVEIFFSRNNAFLASRKLMLLQRISYLNVGIYPFTSIFLLVYCFIPALSLFSGFFIVQKLDIAFLCYLLTMTITLVALGILEGLLKVMAGIEISFTLTAKAAADDNEDIYADLYIVKWSSLLIPPITIGMVNIIAIAFAFARTIYSDNPRWGKFIGGGFFSFWVLAHLNPFAKGLMGRRGKTPTIVFVWSGLLSITVSLLWVAISPPEANSNGGARGGGFQFP

SEQ ID NO: 61 - protein, 1055 aa, Oryza sativa
MEASAGLVAGSHNRNELVLIRGHEEPKPLRALSGQVCEICGDEVGRTVDGDLFVACNECGFPVCRPCYEYERREGTQNCPQCKTRYKRLKGSPRVPGDEDEEDIDDLEHEFNIDDEKQKQLQQDQDGMQNSHITEAMLHGKMSYGRGPDDGDGNSTPLPPIITGARSVPVSGEFPISNSHGHGEFSSSLHKRIHPYPVSEPGSAKWDEKKEVSWKERMDDWKSKQGIVAGGAPDPDDYDADVPLNDEARQPLSRKVSIASSKVNPYRMVIILRLVVLGFFLRYRILHPVPDAIPLWLTSIICEIWFAVSWILDQFPKWYPIDRETYLDRLSLRYEREGEPSLLSAVDLFVSTVDPLKEPPLVTANTVLSILAVDYPVDKVSCYVSDDGASMLTFESLSETAEFARKWVPFCKKFSIEPRAPEFYFSQKVDYLKDKVHPNFVQERRAMKREYEEFKVRINALVAKAQKVPAEGWIMKDGTPWPGNNTRDHPGMIQVFLGHSGGHDTEGNELPRLVYVSREKRPGFQHHKKAGAMNALIRVSAVLTNAPFMLNLDCDHYINNSKAIREAMCFLMDPQVGRKVCYVQFPQRFDGIDVHDRYANRNTVFFDINMKGLDGIQGPVYVGTGCVFRRQALYGYNPPKGPKRPKMVTCDCCPCFGRKKRKHGKDGLPEAVAADGGMDSDKEMLMSQMNFEKRFGQSAAFVTSTLMEEGGVPPSSSPAALLKEAIHVISCGYEDKTDWGLELGWIYGSITEDILTGFKMHCRGWRSVYCMPKRAAFKGSAPINLSDRLNQVLRWALGSVEIFFSRHSPLLYGYKNGNLKWLERFSYINTTIYPFTSLPLLAYCTLPAVCLLTGKFIMPPISTFASLFFIALFISIFATGILEMRWSGVSIEEWWRNEQFWVIGGVSAHLFAVVQGLLKVLAGIDTNFTVTSKATGDEDDEFAELYAFKWTTLLIPPTTLLILNIIGVVAGVSDAINNGSEAWGPLFGKLFFAFWVIVHLYPFLKGLMGRQNRTPTIVVIWSVLLASIFSLLWVRIDPFTIKARGPDVRQCGINC

SEQ ID NO: 62 - protein, 1063 aa, Oryza sativa
MDTASVTGGEHKGKEKTCRVCGEEVAAREDGKPFVACAECGFPVCKPCYEYERSEGTQCCPQCNTRYKRHKGCPRVEGDEDDGGDMDDFEEEFQIKSPTKQKPPHEPVNFDVYSENGEQPAQKWRPGGPALSSFTGSVAGKDLEQEREMEGGMEWKDRIDKWKTKQEKRGKLNRDDSDDDDDKNDDEYMLLAEARQPLWRKVPIPSSKINPYRIVIVLRLVVLCFFLKFRITTPAMDAVPLWLASVICELWFALSWILDQLPKWSPVTRETYLDRLALRYERDGEPCRLAPIDFFVSTVDPLKEPPIITANTVLSILAVDYPVDRVSCYVSDDGASMLLFDTLSETAEFARRWVPFCKKFTIEPRAPEFYFSQKIDYLKDKVQPTFVKERRAMKREYEEFKVRINALVAKAQKKPEEGWVMQDGTPWPGNNTRDHPGMIQVYLGSQGALDVEGSELPRLVYVSREKRPGYNHHKKAGAMNSLVRVSAVLTNAPFILNLDCDHYVNNSKAVREAMCFLMDKQLGKKLCYVQFPQRFDGIDRHDRYANRNTVFFDINMKGLDGIQGPVYVGTGTVFNRQALYGYDPPRPEKRPKMTCDCWPSWCCCCCCFGGGKRGKSHKNKKGGGGGEGGGLDEPRRGLLGFYKKRSKKDKLGGGAASLAGGKKGYRKHQRGFELEEIEEGLEGYDELERSSLMSQKSFEKRFGQSPVFIASTLVEDGGLPQGAAADPAALIKEAIHVISCGYEEKTEWGKEIGWIYGSVTEDILTGFKMHCRGWKSVYCTPARAAFKGSAPINLSDRLHQVLRWALGSVEIFMSRHCPLWYAYGGRLKWLERFAYTNTIVYPFTSIPLLAYCTIPAVCLLTGKFIIPTLNNLASIWFIALFLSIIATGVLELRWSGVSIEDWWRNEQFWVIGGVSAHLFAVFQGLLKVLGGVDTNFTVTSKAAADETDAFGELYLFKWTTLLVPPTTLIIINMVGIVAGVSDAVNNGYGSWGPLFGKLFFSFWVILHLYPFLKGLMGRQNRTPTIVVLWSILLASIFSLVWVRIDPFIPKPKGPVLKPCGVSC

SEQ ID NO: 63 - protein, 1127 aa, Oryza sativa
MASKGILKNGGKPPTAPSSAAPTVVFGRRTDSGRFISYSRDDLDSEISSVDFQDYHVHIPMTPDNQPMDPAAGDEQQYVSSSLFTGGFNSVTRAHVMEKQASSARATVSACMVQGCGSKIMRNGRGADILPCECDFKICVDCFTDAVKGGGGVCPGCKEPYKHAEWEEVVSASNHDAINRALSLPHGHGHGPKMERRLSLVKQNGGAPGEFDHNRWLFETKGTYGYGNAIWPEDDGVAGHPKELMSKPWRPLTRKLRIQAAVISPYRLLVLIRLVALGLFLMWRIKHQNEDAIWLWGMSIVCELWFALSWVLDQLPKLCPINRATDLSVLKDKFETPTPSNPTGKSDLPGIDIFVSTADPEKEPVLVTANTILSILAADYPVDKLACYVSDDGGALLTFEAMAEAASFANLWVPFCRKHEIEPRNPDSYFNLKRDPFKNKVKGDFVKDRRRVKREYDEFKVRVNGLPDAIRRRSDAYHAREEIQAMNLQREKMKAGGDEQQLEPIKIPKATWMADGTHWPGTWLQASPEHARGDHAGIIQVMLKPPSPSPSSSGGDMEKRVDLSGVDTRLPMLVYVSREKRPGYDHNKKAGAMNALVRASAIMSNGPFILNLDCDHYVYNSKAFREGMCFMMDRGGDRLCYVQFPQRFEGIDPSDRYANHNTVFFDVNMRALDGLQGPVYVGTGCLFRRIALYGFDPPRSKDHTTPWSCCLPRRRRTRSQPQPQEEEEETMALRMDMDGAMNMASFPKKFGNSSFLIDSIPVAEFQGRPLADHPSVKNGRPPGALTIPRETLDASIVAEAISVVSCWYEEKTEWGTRVGWIYGSVTEDVVTGYRMHNRGWKSVYCVTHRDAFRGTAPINLTDRLHQVLRWATGSVEIFFSRNNALFASSKMKVLQRIAYLNVGIYPFTSVFLIVYCFLPALSLFSGQFIVQTLNVTFLTYLLIITITLCLLAMLEIKWSGIALEEWWRNEQFWLIGGTSAHLAAVLQGLLKVIAGIEISFTLTSKQLGDDVDDEFAELYAVKWTSLMIPPLTIIMINLVAIAVGFSRTIYSTIPQWSKLLGGVFFSFWVLAHLYPFAKGLMGRRGRTPTIVYVWSGLVAITISLLWIAIKPPSAQANSQLGGSFSFP

SEQ ID NO: 64 - protein, 1215 aa, Oryza sative
MSRRLSLPAGAPVTVAVSPVRSPGGDAVVRRGSGLTSPVPRHSLGSSTATLQVSPVRRSGGSRYLGASRDGGADESAEFVHYTVHIPPTPDRATASVASEAEAAAEAEEVHRPQRSYISGTIFTGGLNCATRGHVLNFSGEGGATAASRAAASGNMSCKMRGCDMPAFLNGGRPPCDCGFMICKECYAECAAGNCPGCKEAFSAGSDTDESDSVTDDDDDEAVSSSEERDQLPLTSMARKFSVVHSMKVPGAAANGNGKPAEFDHARWLFETKGTYGYGNALWPKDGHAHSGAGFVAADEPPNFGARCRRPLTRKTSVSQAILSPYRLLIAIRLVALGFFLAWRIRHPNPEAVWLWAMSVACEVWFAFSWLLDSLPKLCPVHRAADLAVLAERFESPTARNPKGRSDLPGIDVFVTSADPEKEPPLVTANTILSILAADYPVEKLACYLSDDGGALLSFEALAETASFARTWVPFCRKHGVEPRCPEAYFGQKRDFLKNKVRVDFVRERRKVKREYDEFKVRVNSLPEAIRRRSDAYNAGEELRARRRQQEEAAAAAAAGNGELGAAAVETAAVKATWMSDGSHWPGTWTCPAADHARGDHAGIIQAMLAPPTSEPVMGGEAAECGGLIDTTGVDVRLPMLVYVSREKRPGYDHNKKAGAMNALVRTSAIMSNGPFILNLDCDHYVHNSSALREGMCFMLDRGGDRVCFVQFPQRFEGVDPSDRYANHNLVFFDVSMRAMDGLQGPMYVGTGCVFRRTALYGFSPPRATEHHGWLGRRKIKLFLTKKKSMGKKTDRAEDDTEMMLPPIEDDDGGADIEASAMLPKRFGGSATFVASIPVAEYQGRLLQDTPGCHHGRPAGALAVPREPLDAATVAEAIGVISCFYEEKTEWGRRIGWIYGSVTEDVVTGYRMHNRGWRSVYCVTPRRDAFRGTAPINLTDRLHQVLRWATGSVEIFFSRNNALFASPRMKLLQRVAYFNAGMYPFTSVFLLAYCLLPAVSLFSGKFIVQRLSATFLAFLLVITLTLCLLALLEIKWSGITLHEWWRNEQFWVIGGTSAHPAAVLQGLLKVIAGVDISFTLTSKPGNGGGDGGVGGEGNDDEAFAELYEVRWSYLMVPPVTIMMVNAVAIAVAAARTLYSEFPQWSKLLGGAFFSFWVLCHLYPFAKGLLGRRGRVPTIVFVWSGLISMIISLLWVYINPPAGARERIGGGGFSFP

SEQ ID NO: 65 - protein, 1082 aa, Brassica napus
MNTGGRLVAGSHNRNEFVLINADESARIRSVQELSGQTCKICRDEIELTVDGEPFVACNECAFPVCRPCYEYERREGNQACPQCKTRYKRIKGSPRVENDEEEDDIDDLDNEFEYENGGVGFDQVSEGMSVSRRHSGFPQSDLDSAPPGSQIPLLTYGDEDIEISSDRHALIVPPSIGGHSNKSHPASLSDPTIAAHPRPMVPQKDLAVYGYGSVAWKDRMEDWKKKQNEKLQVVRHEGDPDFEDGDDIPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSELSAVDVFVSTVDPLKEPPLITANTVLSILAVDYPVDRVACYVSDDGAAMLTFEALSETAEFARKWVPFCKKYCIEPRAPEWYFCHKMDYLKNKVHPAFVRERRAMKRDYEEFKVKINALVATAQKVPEEGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKAPRKTCNCWPKWCFMCCGSRKNRQAKKVAADKKKKNREASKQIHALENIEEGSVTKGSNVEQSTEAMQLKLEKKFGQSPVFVASARMQNGGMARNASPACLLKEAIQVISCGYEDKTEWGKEIGWIYGSVTEDILTGFKMHSHGWRSVYCTPKLPAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPTTLLIINMIGIVVGISDAISNGYDSWGPLFGRLFFALWVVIHLYPFLKGLLGKQDRMPTIIIVWSILIASILTLLWVRVNPFVAKGGPVLEICGLDCL

SEQ ID NO: 66 - protein, 1066 aa, Brassica napus
MESEGETAGKPMTSVGGQICQICSDNVGKTVDGDRFVACDVCGFPVCRPCYEFERKDGNQSCPQCKTTYKRHKGSPAIPGDKDEDVFADEATVELSYPQKEKISERMLGWHLTRGKGEEMGQPEYDKEVSHNHLPRLTSRQETSGEFSAASPERLSVSSTIGGGKRLPYSSDINQSPHRRISDPVGLGNVAWKERVDGWKMKQEKNNGGPVSTQAASERGGGDIDASTDILADEALLNDEARQPLSRKVSIPSSRINPYRMVIMLRLVILCLFLHYRITNPVPNAFTLWLISVICEIWFAFSWILDQFPKWFPVNRETYLDRLALRYDREGEPSQLAAVDIFVSTVDPLKEPPLVTANTVLSILAVDYPVDKVSCYVSDDGAAMLSFEALAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKICGGSRKKNSKSKKDSDKKKSGRHTDSTVPVFNLDDIEEGVEGAGFDDEKALLMSQMSLEKRFGQSAVFVASTLMENGGVPPTETPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYSGRLKFLERFAYVNTTIYPLTSVPLLLYCTLPAVCLFTNQFIIPQISNIASIWFLSLFLSIFATGILEMRWSGVGIDEWWRNEQFWVIGGVSAHLFAVFQGLLKVLAGIDTNFTVTSKASDEDGDFAELYLFKWTTLLIPPTTLLIVNLVGVVAGFSYAINSGYQSWGPLFGKLFFAFWVIVHLYPFLKGLMGRQNRTPTIVVVWSVLLASIFSLLWVRIDPFTKRVTGPDILECGINC

SEQ ID NO: 67 - protein, 1084 aa, Brassica napus
MNTGGRLIAGSHNRNEFVLINADESARIRSVQELRGQTCEICRDEVELTVDGEPFVACNECAFPVCRPCYEYERREGNQACPQCKTRYKRLKGSPRVENDEEEDDIDDIDNEFDYMNNGGIGFDQVSEGMSVSRRHSGFPQSDLDSAPPGSQIPLLTYGDEDIEISSDRHALIVPPSLSGHSHRGHPASLSDPTIAAHPRPMVPQKDLAVYGYGSVAWKDRMEEWKRKQNEKLQVVKHEGDPDFEDGDDIPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSELSAVDVFVSTVDPLKEPPLITANTVLSILAVDYPVDRVACYVSDDGAAMLTFEALSETAEFARKWVPFCKKYCIEPRAPEWYFCHKMDYLKNKVHPAFVRERRAMKRDYEEFKVKINALVATAQKVPEEGWTMQDGTPWPGNSTRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKAPRKTCNCWPKWCFLCCGSRKNRKAKTAAADKKKKNREASKQIHALENIEEGRVTTKGSNVELSTEAMQLKLEKKFGQSPVFVASARMENGGMARNASPACLLKEAIQVISCGYEDKTEWGKEIGWIYGSVTEDILTGFKMHSHGWRSVYCTPKLPAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAVTGILEMQWGKVGIDDWWRNEQFWVIGGVSAHLFALFQGLLKVLAGVDTNFTVTSKAADDGEFSDLYLFKWTSLLIPPTTLLIINVIGIVVGISDAISNGYDSWGPLFGRLFFALWVVIHLYPFLKGLLGKQDRMPTIIVVWSILLASILTLLWVRVNPFVAKGGPILEICGLDCL

SEQ ID NO: 68 - protein, 1079 aa, Brassica napus
MNTGGRLIAGSHNRNEFVLINADENARIRSVQELRGQTCEICRDEIESTVDGEPFVACNECAFPVCRPCYEYERREGNQACPQCKTRYKRIKGSPRVENDEEEDDVDDIDNEFEYGGNGIGFDQVSEGVSVSRRHSGDLDSAPPGSQIPLLTYGDEDIEISSDRHALIVPPSLSGHGSRVHPVSLSDPTIAAHPRPMVPQKDLAVYGYGSVAWKDRMEEWKRKQNEKLQVVRHEGDPDFEDGDDIPMMDEGRQPLSRKIPIKSSKINPYRMLIVLRLVILSLFFHYRILHPVKDAYALWLTSVICEIWFAVSWVLDQFPKWYPIERETYLDRLSLRYEKEGKPSELSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEEGWTMQDGTPWPGNSTRDHPGMIQVFLGTDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKAPRKTCNCWPKWCFLCCGSRKNRKAKTLAAADKKKKNREASKQIHALENIEEGPVTKGSNVELSSEAMQLKLEKKFGQSPVFVASARMQNGGMARNASPACLLKEAIQVISCGYEDKTEWGKEIGWIYGSVTEDILTGFKMHSHGWRSVYCTPKLPAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAVTGILEMQWGKVGIDDWWRNEQFWVIGGVSAHLFALFQGLLKVLAGVDTNFTVTSKAADDGEFSDLYLFKWTSLLIPPTTLLIINVIGIVVGISDAISNGYDSWGPLFGRLFFALWVVIHLYPFLKGLLGKQDRMPTIIVVWSILLASILTLLWVRVNPFVAKGGPVLEICGLDCL

SEQ ID NO: 69 - protein, 1083 aa, Brassica napus
MEASAGLVAGSYRRNELVRIRHESDGGSKAMKNMDPHTCQICGDNAGLTETGDLFVACNECAFPVCRPCYEYERKDGTQCCPQCKTRYRRLRGHPRVEGDEDEDDVDDIENEFNYAQGANKGRRQQRHGEEFSSSSRHESQPIPLLTHGHTVSGEIRTPDTQSVRTTSGPLGPGDRNAISSPYIDPRQPVPVRIVDPSKDLNSYGLGNVDWKERVEGWKLKQEKNMVQMTGKYHEGKGGEIEGTGSNGEELQMADDSRLPMSRIVPIPPSHLTPYRVVIILRLIILGFFLQYRTTHPVKDAYPLWLTSVICEIWFAFSWLLDQFPKWYPINRETYLDRLAIRYDRDGEPSQLTPVDVFVSTVDPLKEPPLVTANTVLSILAVDYPVDKVACYVSDDGAAMLTFESLSETAEFAKKWVPFCKKFSIEPRAPEFYFAQKIDYLKDKIQPSFVKERRAMKREYEEFKVRINALVAKAQKIPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFLMDPAYGKKCCYVQFPQRFDGIDLHDRYANRNIVFFDINLKGLDGIQGPVYVGTGCCFNRQALYGYDPVLTEEDLEPNIIVKSCCGSRKKGKKSKKYNYDQQRRGINRSDSNAPLFNMDDIEEGFEGYDDERSILMSQKSVEKRFGQSPVFIAATFMEQGGIPPTTNPATLLKEAIHVISCGYEDKTEWGKEIGWIYGSVTEDILTGFKMHARGWMSIYCNPPRPAFKGSAPINLSDRLNQVLRWALGSIEILLSRHCPIWYGYTGRLRLLERLAYINTIVYPITALPLIAYCILPAFCLITDKFIIPEISNYASIWFILLFISIAVTGVLELRWSGVSIEDWWRNEQFWVIGGTSAHLFAVFQGLLKVLAGIDTNFTVTSKASDEDGDFAELYIFKWTALLIPPTTVLVVNLIGIVAGVSYAVNSGYQSWGPLFGKLFFALWVIAHLYPFLKGLMGRQNRTPTIVIVWSVLLASIFSLLWVRINPFVSVTPEANPTAVPGGVF

SEQ ID NO: 70 - protein, 1066 aa, Brassica napus
MESDGETAGKPMTSVGGQICQICSDSVGKTVDGDRFVACDICGFPVCRPCYEYERKHGNQSCPQCKTTYKRHKGSPAIPGDKDEDVFADEATVELNYPQKEKISERMLGWHLTRGKSEEMGQPEYDKEVSHNHLPRLTSRQDTSGEFSAASPERLSVSSTIAGGKRLPYSCDINQSPNRRISDPVGLGNVAWKERVDGWKMKQEKNTGGPVSTQAASERGGGDIDASTDILADEALLNDEARQPLSRKVSIPSSRINPYRMVIMLRLVILCLFLHYRITNPVPNAFTLWLISVICEIWFAFSWILDQFPKWFPVNRETYLDRLALRYDREGEPSQLAAVDIFVSTVDPLKEPPLVTANTVLSILAVDYPVDKVSCYVSDDGAAMLSFEALAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKSKKDSDKKKSGRHTDSTVPVFNLDDIEEGVEGAGFDDEKALLMSQMSLEKRFGQSAVFVASTLMENGGVPPTETPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYSGRLKFLERFAYVNTTIYPLTSVPLLLYCTLPAVCLFTNQFIIPQISNIASIWFLSLFLSIFATGILEMRWSGVGIDEWWRNEQFWVIGGVSAHLFAVFQGLLKVLAGIDTNFTVTSKASDEDGDFAELYLFKWTTLLIPPTTLLIVNLVGVVAGFSYAINSGYQSWGPLFGKLFFAFWVIVHLYPFLKGLMGRQNRTPTIVVVWSVLLASIFSLLWVRIDPFTKRVTGPDILECGINC

SEQ ID NO: 71 - protein, 1082 aa, Brassica napus
MNTGGRLVAGSHNRNEFVLINADESARIRSVQELSGQTCKICRDEIELTVDGEPFVACNECAFPVCRPCYEYERREGNQACPQCKTRYKRIKGSPRVENDEEEDDIDDLDNEFEYENGGVGFDQVSEGMSVSRRHSGFPQSDLDSAPPGSQIPLLTYGDEDIEISSDRHALIVPPSIGGHSNKSHPASLSDPTIAAHPRPMVPQKDLAVYGYGSVAWKDRMEDWKKKQNEKLQVVRHEGDPDFEDGDDIPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSELSAVDVFVSTVDPLKEPPLITANTVLSILAVDYPVDRVACYVSDDGAAMLTFEALSETAEFARKWVPFCKKYCIEPRAPEWYFCHKMDYLKNKVHPAFVRERRAMKRDYEEFKVKINALVATAQKVPEEGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKAPRKTCNCWPKWCFMCCGSRKNRQAKKVAADKKKKNREASKQIHALENIEEGSVTKGSNVEQSTEAMQLKLEKKFGQSPVFVASARMQNGGMARNASPACLLKEAIQVISCGYEDKTEWGKEIGWIYGSVTEDILTGFKMHSHGWRSVYCTPKLPAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPTTLLIINVIGIVVGISDAISNGYDSWGPLFGRLFFALWVVIHLYPFLKGLLGKQDRMPTIIVVWSILLASILTLLWVRVNPFVAKGGPVLEICGLDCL

SEQ ID NO: 72 - protein, 1079 aa, Brassica napus
MNTGGRLIAGSHNRNEFVLINADENARIRSVQELRGQTCEICRDEIESTVEGEPFVACNECAFPVCRPCYEYERREGNQACPQCKTRYKRIKGSPRVENDEEEDDVDDIDNEFEYGGNGIGFDQVSEGVSVSRRHSGDLDSAPPGSQIPLLTYGDEDIEISSDRHALIVPPSLSGHGSKVHPVSLSDPTIAAHPRPMVPQKDLAVYGYGSVAWKDRMEEWKRKQNEKLQVVRHEGDPDFEDGDDIPMMDEGRQPLSRKIPIKSSKINPYRMLIVLRLVILSLFFHYRILHPVKDAYALWLTSVICEIWFAVSWVLDQFPKWYPIERETYLDRLSLRYEKEGKPSELSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEEGWTMQDGTPWPGNSTRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKAPRKTCNCWPKWCFLCCGSRKNRKAKTLAAADKKKKNREASKQIHALENIEEGPVSKGSNVELSSEVMQLKLEKKFGQSPVFVASARMQNGGMARNASPACLLKEAIQVISCGYEDKTEWGKEIGWIYGSVTEDILTGFKMHSHGWRSVYCTPKLPAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAVTGILEMQWGKVGIDDWWRNEQFWVIGGVSAHLFALFQGLLKVLAGVDTNFTVTSKAADDGEFSDLYLFKWTSLLIPPTTLLIINVIGIVVGISDAISNGYDSWGPLFGRLFFALWVVIHLYPFLKGLLGKQDRMPTIIVVWSILLASILTLLWVRVNPFVAKGGPVLEICGLDCL

SEQ ID NO: 73 - protein, 1083 aa, Brassica napus
MEASAGLVAGSYRRNELVRIRHESDGGTKALKNMDPHTCQICGDNAGLTETGDLFVACNECAFPVCRPCYEYERKDGTQCCPQCKTRYRRLRGSPRVEGDEDEDDVDDIENEFNYTQGANKGRRQQRHGEEFSSSSRHESQPIPLLTHGHTVSGEIRTPDTQSVRTTSGPLGPGDRNAISSPYIDPRQPVPVRIVDPSKDLNSYGLGNVDWKERVEGWKLKQEKNMVQMTGKYHEGKGGEIEGTGSNGEELQMADDTRLPMSRIVPIPPSHLTPYRVVIILRLIILGFFLQYRTTHPVKDAYPLWLTSVICEIWFAFSWLLDQFPKWYPINRETYLDRLAIRYDRDGEPSQLTPVDVFVSTVDPLKEPPLVTANTVLSILAVDYPVDKVACYVSDDGAAMLTFESLSETAEFAKKWVPFCKKFSIEPRAPEFYFAQKIDYLKDKIQPSFVKERRAMKREYEEFKVRINALVAKAQKIPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFLMDPAYGKKCCYVQFPQRFDGIDLHDRYANRNIVFFDINLKGLDGIQGPVYVGTGCCFNRQALYGYDPVLTEEDLEPNIIVKSCCGSRKKGKKSKKYNYDQQRRGINRSDSNAPLFNMDDIEEGFEGYDDERSILMSQKSVEKRFGQSPVFIAATFMEQGGIPPTTNPATLLKEAIHVISCGYEDKTEWGKEIGWIYGSVTEDILTGFKMHARGWMSIYCNPPRPAFKGSAPINLSDRLNQVLRWALGSIEILLSRHCPIWYGYTGRLRLLERLAYINTIVYPITALPLIAYCILPAFCLITDKFIIPEISNYASIWFILLFISIAVTGVLELRWSGVSIEDWWRNEQFWVIGGTSAHLFAVFQGLLKVLAGIDTNFTVTSKASDEDGDFAELYIFKWTALLIPPTTVLVVNLIGIVAGVSYAVNSGYQSWGPLFGKLFFALWVIAHLYPFLKGLMGRQNRTPTIVIVWSVLLASIFSLLWVRINPFVSVTPQANPTAVPGGVF

SEQ ID NO: 74 - protein, 1066 aa, Brassica napus
MESDGETAGKPMTSVGGQICQICSDNVGKTVDGDRFVACDICGFPVCRPCYEYERKHGNQSCPQCKTTYKRHKGSPAIPGDKDEDVFADEATVELNYPQKEKISERMLGWHLTRGKSEEMGQPEYDKEVSHNHLPRLTSRQDTSGEFSAASPERLSVSSTIAGGKRLPYSSDINQSPNRRISDPVGLGNVAWKERVDGWKMKQEKNNGGPVSTQAASERGGGDIDASTDILADEALLNDEARQPLSRKVSIPSSRINPYRMVIMLRLVILCLFLHYRITNPVPNAFTLWLISVICEIWFAFSWILDQFPKWFPVNRETYLDRLALRYDREGEPSQLAAVDIFVSTVDPLKEPPLVTANTVLSILAVDYPVDKVSCYVSDDGAAMLSFEALAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKSKKDSDKKKSGRHTDSTVPVFNLDDIEEGVEGAGFDDEKALLMSQMSLEKRFGQSAVFVASTLMENGGVPPTETPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYSGRLKFLERFAYVNTTIYPLTSVPLLFYCTLPAVCLFTNQFIIPQISNIASIWFLSLFLSIFATGILEMRWSGVGIDEWWRNEQFWVIGGVSAHLFAVFQGLLKVLAGIDTNFTVTSKASDEDGDFAELYLFKWTTLLIPPTTLLIVNLVGVVAGFSYAINSGYQSWGPLFGKLFFAFWVIVHLYPFLKGLMGRQNRTPTIVVVWSVLLASIFSLLWVRIDPFTKRVTGPDILECGINC

SEQ ID NO: 75 - protein, 1080 aa, Brassica napus
MEASSGLVAGSYRRNELVRIRHESDGGSKPLKNMDREICQICGDHAGLTETGDLFVACNECAFPVCRPCYDYERKDGTQCCPHCKTRYRRLRGHPRVEGDEDEDDVDDIENEFSYAQGGANKPRRREEFSSSSRHDSQPIPLLTHGHGVSGEIRTPDTQSVRTTSGPLGPGERNAISSSYIDPRQPVPVRIVDPSKDLNSYGLGNVDWKERVEGWKLKQEKNMLQMTGKYHEGKGGEIEGTGSNGEELQMADDTRLPMSRIVPIPPSHLTPYRVVIILRLIILGFFLQYRTTHPVKDAYPLWLTSVICEIWFAFSWLLDQFPKWYPINRETYLDRLAIRYDREGEPSQLTPVDVFVSTVDPLKEPPLVTANTVLSILAVDYPVDKVACYVSDDGAAMLTFESLSETAEFAKKWVPFCKKFSIEPRAPEFYFQQKIDYLKDKIQPSFVKERRAMKREYEEFKVRINALVAKAQKIPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFLMDPAYGKKCCYVQFPQRFDGIDLHDRYANRNIVFFDINLKGLDGIQGPVYVGTGCCFNRQALYGYDPVLTEEDLKPNIIVKSCCGSRKKGKNSKKYSYDQKRRGISRSDSNAPLFNMDDIDEGFEGYDDDRSILMSQKSVEKRFGQSPVFIAATFMEQGGIPPTTNPATLLKEAIHVISCGYEDKTEWGKEIGWIYGSVTEDILTGFKMHARGWMSIYCNPPRPAFKGSAPINLSDRLNQVLRWALGSIEILLSRHCPIWYGYTGRLRLLERLAYINTIVYPITALPLIAYCILPAFCLITDKFIIPEISNYASIWFILLFISIAVTGILELRWSGVSIEDWWRNEQFWVIGGTSAHLFAVFQGLLKVLAGIDTNFTVTSKASDEDGDFAELYIFKWTALLIPPTTVLVVNMIGIVAGVSYAINSGYQSWGPLFGKLFFALWVIAHLYPFLKGLLGRQNRTPTIVIVWSVLLASIFSLLWVRINPFVSVTPAANPNAVPGGVF

SEQ ID NO: 76 - protein, 1080 aa, Brassica napus
MEASSGLVAGSYRRNELVRIRHESDGGSKPLKNMDREICQICGDHAGLTETGDLFVACNECAFPVCRPCYEYERKDGTQCCPHCKTRYRRLRGHPRVEGDEDEDDVDDIENEFSYAQGGANKPRRREEFSSSSRHDSQPIPLLTHGHGVSGEIRTPDTQSVRTTSGPLGPGDRNAISSPYIDPRQPVPVRIVDPSKDLNSYGLGNVDWKERVEGWKLKQEKNMLQMTGKYHEGKGGEIEGTGSNGEELQMADDSRLPMSRIVPIPPSHLTPYRVVIILRLIILGFFLQYRTTHPVKDAYPLWLTSVICEIWFAFSWLLDQFPKWYPINRETYLDRLAIRYDRDGEPSQLTPVDVFVSTVDPLKEPPLVTANTVLSILAVDYPVDKVACYVSDDGAAMLTFESLSETAEFAKKWVPFCKKFSIEPRAPEFYFAQKIDYLKDKIQPSFVKERRAMKREYEEFKVRINALVAKAQKVPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFLMDPAYGKKCCYVQFPQRFDGIDLHDRYANRNIVFFDINLKGLDGIQGPVYVGTGCCFNRQALYGYDPVLTEEDLQPNIIVKSCCGSRKKGKNSKKYSYDQKRRGISRSDSNAPLFNMDDIDEGFEGYDDDRSILMSQKRVEKRFGQSPVFIAATFMEQGGIPPTTNPATLLKEAIHVISCGYEDKTEWGKEIGWIYGSVTEDILTGFKMHARGWMSIYCNPPRPAFKGSAPINLSDRLNQVLRWALGSIEILLSRHCPIWYGYTGRLRLLERLAYINTIVYPITALPLIAYCILPAFCLITDKFIIPEISNYASIWFILLFISIAVTGILELRWSGVSIEDWWRNEQFWVIGGTSAHLFAVFQGLLKVLAGIDTNFTVTSKASDEDGDFAELYIFKWTALLIPPTTVLVVNLIGIVAGVSYAINSGYQSWGPLFGKLFFALWVIAHLYPFLKGLLGRQNRTPTIVIVWSVLLASIFSLLWVRINPFVSVIPAANPNAVPGGVF

SEQ ID NO: 77 - protein, 1066 aa, Brassica napus
MESEGETAGKPMTSVGGQICQICSDNVGKTVDGDWFVACDVCGFPVCRPCYDFERKDGNQSCPQCKTTYKRHKGSPAIPGDKDEDVFADEATVELSYPQKEKISERMLGWHLTRGKGEEMGQPEYDKEVSHNHLPRLTSRQETSGEFSAASPERLSVSSTIGGGKRLPYSSDINQSPHRRISDPVGLGNVAWKERVDGWKMKQEKNNGGPVSTQAASERGGGDIDASTDILADEALLNDEARQPLSRKVSIPSSRINPYRMVIMLRLVILCLFLHYRITNPVPNAFTLWLISVICEIWFAFSWILDQFPKWFPVNRETYLDRLALRYDREGEPSQLAAVDIFVSTVDPLKEPPLVTANTVLSILAVDYPVDKVSCYVSDDGAAMLSFEALAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKSKKDSDKKKSGRHTDSTVPVFNLDDIEEGVEGAGFDDEKALLMSQMSLEKRFGQSAVFVASTLMENGGVPPTETPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYSGRLKFLERFAYVNTTIYPLTSVPLLLYCTLPAVCLFTNQFIIPQISNIASIWFLSLFLSIFATGILEMRWSGVGIDEWWRNEQFWVIGGVSAHLFAVFQGLLKVLAGIDTNFTVTSKASDEDGDFAELYLFKWTTLLIPPTTLLIVNLVGVVAGFSYAINSGYQSWGPLFGKLFFAFWVIVHLYPFLKGLMGRQNRTPTIVVVWSVLLASIFSLLWVRIDPFTKRVTGPDILECGINC

SEQ ID NO: 78 - protein, 1084 aa, Brassica napus
MNTGGRLIAGSHNRNEFVLINADESARIRSVQELRGQTCEICRDEVELTVDGEPFVACNECAFPVCRPCYEYERREGNQACPQCKTRYKRLKGSPRVENDEEEDDIDDIDNEFDYMNNGGIGFDQVSEGMSVSRRHSGFPQSDLDSAPPGSQIPLLTYGDEDIEISSDRHALIVPPSLSGHSHRGHPASLSDPTIAAHPRPMVPQKDLAVYGYGSVAWKDRMEEWKRKQNEKLEVVKHEGDPDFEDGDDIPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSELSAVDVFVSTVDPLKEPPLITANTVLSILAVDYPVDRVACYVSDDGAAMLTFEALSETAEFARKWVPFCKKYCIEPRAPEWYFCHKMDYLKNKVHPAFVRERRAMKRDYEEFKVKINALVATAQKVPEEGWTMQDGTPWPGNSTRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKAPRKTCNCWPKWCFLCCGSRKNRKAKTAAADKKKKNREASKQIHALENIEEGRVTTKGSNVELSTEAMQLKLEKKFGQSPVFVASARMENGGMARNASPACLLKEAIQVISCGYEDKTEWGKEIGWIYGSVTEDILTGFKMHSHGWRSVYCTPKLPAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAVTGILEMQWGKVGIDDWWRNEQFWVIGGVSAHLFALFQGLLKVLAGVDTNFTVTSKAADDGEFSDLYLFKWTSLLIPPTTLLIINVIGIVVGISDAISNGYDSWGPLFGRLFFALWVVIHLYPFLKGLLGKQDRMPTIIVVWSILLASILTLLWVRVNPFVAKGGPILEICGLDCL

SEQ ID NO: 79 - protein, 1079 aa, Helianthus annum
MQANGGLVAGSHKRNELVRIRHDSDGGPKPLKDLNGQTCQICGDTVGLTETGDIFVACNECAFPVCRPCYEYERRDGNQACPQCKTRYRRHKGSPRVDGDEEEDDVDDLENEFSYPQGNNKAARQWQGDDANLSSSARHDPLPLLTNGQQVSGEIPSVRDNLSVRSTSGPLGPSDKQLPYIDPRQPVPVRIVDPTKDLNAYGLGNVDWKERVEGWKLKQEKNMQMTNRYGGEGKGGDEIERTGSNGEELQMADDARQPMSRVVPISSAHLTPYRIVIILRLIILGFFLQYRCSHPVNDAYPLWLVSVICEVWFALSWLLDQFPKWFPVERETYLDRLALRYDREGEPSQLAPIDVFVSTVDPLKEPPLITANTVLSILAVDYPVDKVSCYVSDDGSAMLTFESLSETAEFARKWVPFCKKHSIEPRAPEFYFAQKIDYLKDKIQPSFVKERRAMKREYEEFKVRINALVAKAQKMPEEGWTMQDGTPWPGNNPRDHPGMIQVFLGHSGGLDTDGNELPRLVYVSREKRPGFQHHKKAGAMNALIRVSAVLTNGAYLLNVDCDHYFNNSKALKEAMCFMMDPAYGKKTCYVQFPQRFDGIDLHDRYANRNIVFFDINLKGLDGIQGPVYVGTGCCFNRQALYGYDPVLTEADLEPNIIIKSCCGSRKKGKNSNKYTDKKRAVKRSESNIPIFNTEDMDEGVEGYDEEKSLLMSQRSLEKRFGQSSVFISATFMEMGGIPPTTNSATLLKEAIHVISCGYEDKTEWGKEIGWIYGSVTEDILTGFKMHARGWISIYCMPPRPAFKGSAPINLSDRLNQVLRWALGSIEILLSRHCPIWYGYNGKLKLLERLAYINTIVYPLTSIPLLAYCVLPAVCLLTGKFIIPEISNYASMWFILLFISIAATGILELRWSGVSIEDWWRNEQFWVIGGTSAHLFAVFQGLLKVLAGIDTNFTVTSKASDEDGDFAELYIFKWTALLIPPTTVLIVNLVGIVSGVSTAINSGYQSWGPLFGKLFFAIWVIVHLYPFLKGLLGRQNRTPTIVIVWSILLASIFSLLWVRIDPFTTDDKLDSIRGQCGIDC

SEQ ID NO: 80 - protein, 1081 aa, Helianthus annum
MESEGETGGTSMKNVGGQVCQICGDTVGTTAKGDPFVACDVCAFPVCRPCYEYERKDGNQSCPQCKTRYKRLKGSPAIPGDREEDIDGDDETTNFPFSSQTQNEKQKTAERMLNWHMTYGRGDDNSAPNYDKEVSHNHIPLLTGGHEVSGELSAASPQRLSVSSPPPGGERLTHSLPYSAYANQSPNIRVVDPVREFGSTGLGNLAWKERVDGWKMKQDKNVAPMTTSRAASERGQDIDASTDVLDDALLNDEARQPLSRKVSIPSSRINPYRMVIVLRLVILCIFLHYRITNPVTNAYPLWLLSVICEIWFAISWILDQFPKWLPVNRETYLDRLSLRYEREGEPSQLAAVDIFVSTVDPLKEPPLVTANTVLSILAVDYPVDKVSCYVSDDGAAMLSFESLSETSEFARKWVPFCKKYNIEPRAPEWYFAQKIDYLKDKIQPTFVKDRRAMKREYEEFKIRINGLVAKAQKVPDEGWIMQDGTPWPGNNTRDHPGMIQVFLGQNGGLDSEGNELPRLVYVSREKRPGFQHHKKAGAMNALVRVSAVLTNGPFLLNLDCDHYINNSKALREAMCFMMDPNLGKYVCYVQFPQRFDGIDRNDRYANRNTVFFDINLRGLDGIQGPVYVGTGCVFNRTALYGYEPPLKPKKKREKGFFSSCFGESRKKSSKSSKKGSDKKKSSKPVDPTVPVFSLEDIEEGVEGAGFDDEKSLLMSQMSLEKRFGQSAVFVASTLMENGGVPQSAAPETLLKEAIHVISCGYEDKTDWGNEIGWIYGSVTEDILTGFKMHARGWRSIYCMPPRPAFKGSAPINLSDRLNQVLRWALGSVEILFSRHCPIWYGYSGRLKWLERFAYINTTIYPITSIPLLVYCTLPAVCLLTGKFIIPQISNLASLWFISLFLSIFATGILEMRWSGVGIDEWWRNEQFWVIGGVSAHLFAVFQGLLKVLAGIDTNFTVTSKASDEDGDFAELYLFKWTTLLIPPTTLLIVNLVGVVAGISYAINSGYQSWGPLFGKLFFAFWVIVHLYPFLKGLMGKQNRTPTIVVVWSILLASIFSLLWVRIDPFTTKVTGPDVKFCGINC

SEQ ID NO: 81 - protein, 1040 aa, Helianthus annum
MQASAGLVAGSHNRNELVVIHGHEEPKPLKDMTGQVCEICGDEIGLTVDGDLFVACNECGFPVCRPCYEYERREGSQNCPQCKTRYKRLKGSPRVEGDDDEEDVDDIEHEFNIDDEHNKNNNIAEAMLHGKMSYGRGPEDDDNNNTQYPPVIAGRSAHVSDEFPISTQPHGEHLSSLHKRVHPYGSPEYGSGRWDDKKDGGWKERMEEWKMHQQGNLGAEIDDSVDPDMAMLDEARQPLSRKVPIASSKINPYRMVIVARLFILAIFLRYRLMNPVQDGFGLWLTSVICEIWFAFSWILDQFPKWFPIDRETYLDRLSLRYEREGEPNMLCPVDVFVSTVDPLKEPPLVTANTVLSILAMDYPVDKISCYISDDGASMLSFESLSETAEFARKWVPFCKKFAIEPRAPEMYFSDKIDYLKDKVQPTFVKERRAMKREYEEFKVRINALVAKAMKAPAEGWIMQDGTPWPGNNTKDHPGMIQVFLGQSGGTDVEGNELPRLVYVSREKRPGFQHHKKAGAMNALVRVSGVLTNAPFMLNLDCDHYLNNSKAAREAMCFLMDPQIGRKVCYVQFPQRFDGIDRHDRYANRNTVFFDINMKGLDGIQGPVYVGTGCVFRRQALYGYDPPKGPKRPKMVSCDCCPCFGRRKKNPKFEKHGDVENVQGYNDDDKELLKSQMNFEKKFGQSAIFVTSTLMVDGGVPPSSSPASLLKEAIHVISCGYEDKTEWGLELGWIYGSITEDILTGFKMHCRGWRSIYCMPKRPAFKGSAPINLSDRLNQVLRWALGSVEIFFSRHSPLLYGYKGGNLKWLERFAYVNTTIYPFTALPLLAYCILPAICLLTGKFIMPEISTLASLFFISLFLSIFATGILELRWSGVSIEEWWRNEQFWVIGGVSAHLFAVIQGLLKVLAGIDTNFTVTSKATDDEEFGELYAFKWTTLLIPPTTILIINMVGVVAGISDAINNGYQSWGPLFGKLFFAFWVILHLYPFLKGLMGKQNRTPTIVVIWSILLASIFSLLWVRIDPFVLKTKGPDVKQCGLNC

SEQ ID NO: 82 - protein, 736 aa, Helianthus annum
HALIIPPFMNRAKRVHPMPFSDTASSVSLPPRPMDPKKDLAVYGYGTVAWKDRMEEWRRRQNDKLQMVKHQGDGGGGQNDGDVDDPDMPKMDEGRQPLSRKLPISSSKINPYRMVILIRMAILGLFFHYRILHPVNDAYALWLISVICEIWFAVSWIFDQFPKWFPIERETYLDRLSLRYEKEGKPSELAPVDVFVSTVDPMKEPPLITANTVLSILAVDYPVDKVACYVSDDGAAMLTFEALSETSEFARKWVPFCKKFNIEPRAPEWYFAEKVDYLKDKVHPSFVRERRAMKREYEEFKIRINGLVTMAQKVPEEGWTMQDGTPWPGNDVRDHPGMIQVFLGQSGGLDSEGNELPRLVYVSREKRPGFQHHKKAGAMNALVRVSAVLNNGPFILNLDCDHYINNSKALREAMCFMMDPNLGKYVCYVQFPQRFDGIDRNDRYANRNTVFFDINLRGLDGIQGPVYVGTGCVFNRTALYGYEPPIKPKKKREKGVLSSCFGASRNKSSNSNKKGSDKKKSSRHDDPTVPVFSLEDIEEGVEGVGIDDEKSLLMSQMTLEKRFGQSAVFVASTLMENGGVPQSAAPETLLKEAIHVISCGYEDKTDWGSEIGWIYGSVTEDILTGFKMHARGWRSIYCMPPRAAFKGSAPINLSDRLNQVLRWALGSIEILFSRHCPIWYGYSGRLKWLERLACINTTIYPVTAIPLLVYCTLPAVCLLTGKFIIPQISNLASLWF

SEQ ID NO: 83 - protein, 509 aa, Helianthus annum
MLQGIISILIIRVHKIIEICICSTCFLGNNGVQDVEGNKLQRLVYVSREKRPGFDHHKKAGAMNALIRVSAVISNAPYMLNVDCDHYINNSKALREAMCFMMDPTSGKKICYVQFPQRFDGIDRHDRYSNRNVVFFDINMKGLDGIQGPIYVGTGCVFRRQALYGYDAPTKKKPPGKTCNCLPKWLLCCCSSRKKKAKGKSKKSKEKSTKGKKSKDPPTQIHALENIEEGIEGIDSEKSSLMPQIKFEKKFGQSPVFIASTLLEDGGVPPGASSASLLKEAIHVISCGYEDKTEWGKEVGWIYGSVTEDILTGFKMHCHGWRSVYCIPKRAAFKGSAPINLSDRLHQVLRWALGSVEILLSRHCPIWYGYGCGLKPLERFSYINSVVYPLTSVPLLAYCTLPAVCLLTGKFIVPEISNYASILFMLMFLSIAVTSILEIQWGGVGIDDLWRNEQFWVIGGVSAHLFALVQGLLKVLAGVNTNFTVTSKGGDDGEFSELYLFKWTTLLIP

SEQ ID NO: 84 - DNA, 3246 bp, Arabidopsis thaliana
atggaagcttcagctggacttgttgctggatcttacagaagaaacgagcttgttaggatcaggcacgagtctgatggtggaactaagcctctcaagaacatgaacggacagatctgccaaatctgcggagatgatgttggactcgctgagactggtgatgttttcgttgcttgtaacgagtgcgctttccctgtgtgtagaccttgttacgagtacgagagaaaggatggaactcagtgttgccctcagtgcaagaccagattcagaaggcatagaggatctccaagggttgagggtgatgaagatgaggatgatgtggatgatatcgagaacgagttcaactacgctcagggtgctaacaaggctagacatcagagacacggtgaagagttctcttcatcttctaggcacgagagtcagcctatccctcttctcactcatggacacactgtgtctggtgagatcagaacccctgatacccagtctgtgagaactacttctggacctctcggaccttctgataggaacgctatctcttctccttacatcgatcctaggcagcctgtgcctgttagaatcgtggatccttctaaggatctcaactcttacggactcggaaatgtggattggaaagagagagttgagggttggaagctcaagcaagagaagaacatgctccagatgaccggaaagtaccacgaaggtaagggtggtgagattgagggaactggatctaacggtgaggaactccagatggctgatgataccagactccctatgtctagggttgtgccaatcccttcatctaggctcaccccttacagagtggtgatcatccttaggcttatcatcctctgctttttcttgcagtacaggaccacccaccctgtgaagaatgcttaccctctttggctcacctctgtgatctgcgagatttggttcgctttctcttggctcctcgatcagttccctaagtggtatcctatcaacagggaaacctacctcgataggctcgctatcaggtacgatagagatggtgagccttctcagctcgttcctgttgatgtgttcgtgtctactgtggatcctctcaaagagcctcctctcgttactgctaacaccgtgctttctatcctctcagtggattaccctgtggataaggtggcatgctacgtgtcagatgatggatctgctatgctcaccttcgagtctctcagtgagactgctgagttcgctaagaagtgggttccattctgcaagaagttcaatatcgagcctagggctcctgagttctacttcgcacagaagatcgattacctcaaggataagatccaaccatctttcgtgaaagaaagaagggctatgaagagggaatacgaagagttcaaggtgaggatcaacgctctcgttgctaaggctcaaaagatccctgaagagggttggactatgcaggatggtactccttggcctggaaacaacactagagatcaccctggaatgatccaggtgttcctcggacattctggtggactcgatactgatggtaacgagcttcctaggctcatctacgtgagtagagaaaagaggcctggattccagcaccacaagaaagctggtgctatgaacgctctcatcagggtttcagctgtgcttaccaacggtgcttacctcctcaatgttgattgcgatcactacttcaacaactctaaggctatcaaagaggctatgtgcttcatgatggatccagctatcggaaagaagtgctgctacgttcagttcccacagaggttcgatggaatcgatctccacgataggtacgctaacagaaacatcgtgttcttcgatattaacatgaagggactcgatggtatccagggacctgtttacgttggaactggttgctgcttcaacaggcaggctctttacggatacgatcctgtgctcactgaggaagatctcgagcctaacatcatcgtgaagtcttgctgcggatctaggaagaagggaaagtcatctaagaagtacaactacgagaagagaaggggaatcaacaggtctgattctaacgctccactcttcaacatggaagatatcgatgagggattcgagggatacgatgatgagagatcaatcctcatgtctcagagatctgtggaaaagaggttcggacagtctcctgtgttcattgctgcaaccttcatggaacagggtggaatccctcctactactaaccctgctactctcctcaaagaagctatccacgttatctcttgcggatacgaggataagaccgagtggggaaaagaaatcggatggatctacggatctgtgaccgaggatatcttgaccggattcaagatgcacgctaggggatggatcagtatctactgcaatcctcctaggcctgctttcaagggatctgctccaatcaacctctcagataggctcaaccaggttctcagatgggcacttggatctatcgagatcctccttagtaggcactgccctatctggtacggataccacggtagacttagactcctcgagaggatcgcttacatcaacaccatcgtgtaccctatcacctctatcccacttatcgcttactgcatccttcctgctttctgcctcatcaccgatagattcatcatccctgagatctctaactacgcttctatctggttcatcctccttttcatctcaatcgctgtgaccggaatcctcgagcttagatggtctggtgtgtctatcgaggattggtggaggaatgagcagttctgggttatcggaggaacttctgctcatctcttcgctgttttccagggactccttaaggttctcgctggaattgataccaacttcactgtgacctcaaaggctaccgatgaggatggtgatttcgctgagctttacatcttcaagtggaccgctctcctcatccctccaacaactgttctcctcgttaacctcatcggaatcgtggctggtgtttcttacgctgtgaactctggttaccagtcttggggaccactcttcggaaagcttttcttcgctctttgggtgatcgcacacctctacccattccttaagggacttctcggaaggcagaacaggactcctactatcgttatcgtgtggtctgtgctcctcgcttcaatcttctcattgctctgggtgagaatcaaccctttcgtggatgctaaccctaacgctaacaacttcaacggaaaaggtggtgtgttctga

SEQ ID NO: 85 - DNA, 3198 bp, Arabidopsis thaliana
atggaatctgaaggtgaaactgctggaaagcctatgaagaacatcgtgcctcagacttgccagatctgctctgataacgtgggaaagaccgtggatggtgatagattcgtggcttgcgatatctgctcattccctgtgtgtagaccttgctacgagtacgagaggaaggatggaaaccagtcttgtcctcagtgcaagaccagatacaagaggctcaagggatctcctgctatccctggtgataaggatgaggatggacttgctgatgagggaaccgttgagttcaactaccctcagaaagagaagatctctgagaggatgctcggatggcatctcactagaggtaagggtgaagaaatgggagagcctcagtacgataaggaagtgtctcataaccacctccctaggctcacctctagacaggatacttctggtgagttctctgctgcttctcctgagaggctctctgtgtcatctactatcgctggtggaaagaggctcccttactcttctgatgtgaaccagtctcctaacagaaggatcgttgatcctgttggactcggaaacgtggcatggaaagaaagagtggatggatggaagatgaagcaagagaagaacaccggacctgtgtctactcaagctgcttctgaaaggggtggtgtggatatcgatgcttctaccgatatcctcgcagatgaggcacttctcaacgatgaggctagacagccactctctaggaaggtgtcaatcccatcttctaggatcaacccttacagaatggtgatcatgctcaggctcgttatcctctgcttgttcctccactacaggatcactaaccctgtgcctaacgctttcgctctctggctcgtttctgttatctgcgagatctggttcgcactctcttggatccttgatcagttccctaagtggttccctgtgaacagagagacttacctcgatagactcgctctcaggtacgatagagagggtgagccttctcaactcgctgcagttgatatcttcgtgtctaccgtggatcctctcaaagagcctcctctcgttactgctaacaccgtgctttctatcctcgctgtggattaccctgtggataaggtgtcatgctacgtgtcagatgatggtgctgctatgctctcattcgagtctctcgctgagacttctgagttcgctagaaagtgggtgccattctgcaagaagtactctatcgaacctagggctcctgagtggtacttcgctgctaagatcgattacctcaaggataaggttcagacctctttcgtgaaggatagaagggctatgaagagagagtacgaagagttcaagatcagaatcaacgctctcgtgtctaaggctctcaagtgtcctgaagagggatgggttatgcaggatggaactccttggcctggaaacaacactagagatcaccctggaatgatccaggtgttccttggacaaaacggtggattggatgctgagggaaacgagcttcctagactcgtgtacgtgtcaagagaaaagaggcctggattccagcaccacaagaaagctggtgctatgaacgctcttgtgagggtttcagctgtgctcactaacggacctttcatcctcaacctcgattgcgatcactacatcaacaactctaaggcactcagggaagctatgtgcttcctcatggatcctaacctcggaaagcaggtttgctacgttcagttcccacagaggttcgatggaatcgataagaacgataggtacgctaataggaacaccgtgttcttcgatatcaacctcagaggactcgatggtatccagggacctgtttacgttggaactggatgcgtgttcaacaggactgctctttacggatacgagcctcctatcaaggtgaagcacaagaagccttcactcctcagtaagctctgcggaggatctaggaagaagaactcaaaggctaagaaagagagtgataagaagaagtctggaaggcacaccgattctaccgtgcctgtgttcaaccttgatgatattgaagagggtgttgagggtgctggattcgatgatgagaaagctctcctcatgtctcagatgtctctcgagaagaggttcggacagtctgctgtgttcgttgcttcaaccctcatggaaaatggtggtgtgcctccttctgctacccctgaaaaccttcttaaagaggctattcacgttatctcttgcggttacgaggataagtctgattggggaatggaaatcggatggatctacggatctgtgaccgaggatattctcaccggattcaagatgcacgctaggggttggagatctatctactgcatgcctaagctccctgctttcaagggttctgctccaatcaacctctctgataggctcaaccaggttctcagatgggctttgggatctgttgagatcctcttcagtaggcactgccctatctggtacggatacaacggtagactcaagttcctcgagaggttcgcttacgtgaacactaccatctaccctattacctctatccctctcttgatgtactgcacccttcctgctgtttgcctcttcaccaaccagttcatcatccctcagatctctaacattgcttctatctggttcctcagtctcttcctctcaatcttcgctaccggaatccttgagatgaggtggtctggtgtgggaattgatgagtggtggagaaatgagcagttctgggttatcggtggtgtgtctgctcatctcttcgctgttttccagggaatcctcaaggttctcgctggaattgataccaacttcaccgtgacctctaaggcttctgatgaagatggtgatttcgctgagctttacctcttcaagtggactaccctccttatccctcctacaacactcctcatcgtgaacctcgttggagttgtggctggtgtgtcatacgctatcaactctggttaccagtcatggggaccactcttcggaaagcttttcttcgctttctgggtgatcgtgcacctctacccattccttaagggactcatgggtagacagaacaggactcctactatcgttgtggtgtggtctgtgctcctcgcttcaatcttctcactcctctgggtgagaatcgatccattcacttctagagtgaccggtcctgatatcttggagtgcggaatcaactgctga

SEQ ID NO: 86 - DNA, 3452 bp, Brassica napus
gatctaatcgcatttcgcttatccccagcagatttgaactctccctacgattcgttgatcgtatatggaatccgaaggagaaaccgcgggtaagccgatgacgagcgtcggcggccagatatgccagatctgtagtgacaatgtaggcaagactgttgatggagaccggttcgtggcgtgtgatgtttgtggattcccggtttgcaggccttgctatgagtttgagaggaaggatgggaatcaatcttgtcctcagtgcaaaaccacttacaagaggcacaaggggagtcctgctattcctggtgataaagatgaggatgtcttcgctgatgaagcaactgttgagttaagctacccgcagaaggagaagatttcggagaggatgcttgggtggcatcttacacgtggcaaaggagaggagatggggcagcctgagtatgacaaagaggtttctcataatcatctccctcgtctcaccagtagacaagagacttcaggagagttttctgctgcctcgcctgaacgcctctctgtttcttctaccattggtggtggaaagcgccttccctattcatctgatatcaatcaatcaccacatagaaggatttcggatcctgttggactagggaatgtagcttggaaggagagagttgatggctggaaaatgaagcaggagaagaataatggtggtcctgtgagcacccaggctgcttctgaaagaggtggaggagatattgatgccagcactgatatcctcgcagatgaggctttgctgaatgacgaagcgagacagcctctgtcgaggaaagtttcgattccttcatcaaggatcaatccttaccgaatggttattatgttgcgtcttgtcattctatgtctcttcttgcactaccgtataacaaatccagtgccaaatgccttcactctgtggctgatctcagtgatatgtgagatctggtttgccttttcctggattttggatcagtttcccaaatggtttcctgtcaaccgtgaaacctacctagataggcttgctttaagatatgatcgtgaaggtgagccttcacagctagcggctgtggacatcttcgtgagtactgttgaccccttgaaggagccaccccttgtgactgctaacacagtgctctctattttggctgttgactacccggttgacaaggtgtcctgttatgtttctgatgatggtgctgctatgttatcatttgaagcacttgcagaaacatcagagtttgctcgtaaatgggtaccattctgcaagaaatatagcattgagcctcgcgcaccagaatggtattttgctgcgaaaatagattatctgaaggataaagttcagacatcatttgtcaaagatcgtagagctatgaagagggaatatgaggaatttaagatccgaatcaatgcacttgtttctaaggcccttaaatgtcctgaagaagggtgggttatgcaagatggcacaccatggcctggaaataatacaagagaccatccaggaatgatccaggttttcttagggcaaaacggtgggcttgatgcagagggcaatgagcttccgcgtttggtgtatgtttctcgagaaaagcgaccaggattccagcaccacaaaaaggctggtgctatgaatgcacttgttagagtttcagcagtccttaccaatggacctttcatcttgaatcttgattgtgatcattacatcaataacagcaaggccttgagagaagcaatgtgcttcctgatggatccaaacctagggaagcaagtgtgttatgttcagttccctcaaagattcgatggtatcgataagaacgatagatatgctaatcgtaataccgttttctttgatatcaacttgagaggtttagatgggattcaaggacctgtatatgtgggaactgggtgtgttttcaacagaacagcattatatggttatgaacctccaattaaagtaaaacacaagaagccaagtcttttatctaagatctgtggtgggtcaagaaagaagaattccaaatctaagaaagattcggacaaaaagaaatcaggcaggcatactgactcaactgttcctgtattcaaccttgatgacatagaagagggagttgaaggtgctggttttgacgatgaaaaggcgctcttgatgtcacaaatgagcctggagaagcgatttggacagtctgctgtttttgttgcgtctaccctaatggaaaatggaggcgttcctcctacagaaactcctgaaaaccttctcaaagaggcgatccatgtcattagttgtggatacgaggataagtcagactggggaatggagattggatggatctatggttcggtgacagaagatattctgactgggttcaagatgcatgcccgtggatggagatccatttactgtatgccaaagcttccggcgttcaaggggtctgctcctatcaatctttcagatcgtctgaaccaagtgctgaggtgggctctaggttccgttgagattctcttcagtcggcattgtcctatatggtatggttacagtgggaggcttaaatttcttgagaggtttgcatatgtgaacaccaccatctacccactcacctccgtccctcttctcttgtattgtacattgcccgccgtttgtctcttcaccaaccagttcatcatccctcagattagtaacattgcaagtatatggtttctgtctctctttctgtctattttcgccacgggtatactcgaaatgaggtggagtggcgtaggcatagacgaatggtggagaaacgagcagttctgggtcattggaggagtatccgctcacttattcgccgtgtttcaaggtctcctcaaagtcctagccggtatcgacacaaacttcacagtcacgtcaaaagcttcagacgaagacggagacttcgctgagctctacttgttcaaatggacaacgcttctgattccgccgacgacgctgctcattgtaaacctcgtgggagttgttgcgggattctcgtacgcaatcaacagtggataccaatcttggggaccgctctttggtaagctgttcttcgcgttttgggtgattgttcacttgtaccctttcctcaagggtttgatggggagacagaacaggactcccaccattgttgtggtctggtctgttctcttggcttccatcttctccttgttgtgggttaggatcgatcccttcactaaaagagtcactggcccggacatactcgaatgtggaatcaactgttgagaagtgagcaataatatgctttttgggcttcaaaagacgcagaaaatatataattttattgttttatttgttaaacggtttatttatcttgtttgtgtgtattgtcttgttcttgtttcgttttttcatgtgtagaatatattaccctagttactttggaaagattattaagtcaaaagcgaatatt

SEQ ID NO: 87 - DNA, 3676 bp, Brassica napus
aaaataggcaaatcagattggtgtttgaagtttaggatcaaagaaagaaagaaagagagtgtcagtgttgaacatctctctgtcggtgtgtgatctgactcatcagcatcaatggaggccagtgccggcttggtcgctggttcctaccggagaaacgagctcgttcggatccgtcacgaatccgacggcgggtccaaagctatgaagaatatggatccacatacatgtcagatctgtggtgataacgctgggctcactgaaactggagatctttttgtggcttgcaatgaatgtgccttccctgtctgccgtccttgctatgagtacgagaggaaagatggaactcagtgttgccctcaatgcaagactagatacagacgtctcaggggtcatcctcgtgttgaaggggatgaagatgaggatgatgttgatgatattgagaacgagtttaattacgctcaaggagctaacaagggaagacgccaacaacgtcatggtgaagagttctcttcctcttctagacatgaatctcaaccaattcctcttctcactcatggccacacggtttcaggggaaattcgcacgcctgacacacaatctgtgcgtactacatcaggtcctttagggcctggtgacaggaatgccatttcatctccatatattgacccacgccaacctgtacctgtgagaatcgtagacccttcgaaagatttgaactcttatgggcttggcaatgttgactggaaagaaagggttgaaggctggaagctgaagcaggagaagaatatggtacagatgactggtaaataccacgaagggaaaggtggagaaattgaaggcactggttccaacggcgaagaactccaaatggctgatgattcgaggctgcctatgagccgtattgtgcctatcccgccttctcatctcacaccttaccgggttgtgattattctccggcttatcatcttgggattcttcttgcaatatcgtacaactcaccctgtgaaagatgcttatccattgtggttgacctcagttatttgtgagatctggtttgcattttcttggcttctcgatcagtttcccaaatggtaccctattaaccgagagacttatcttgaccgtctcgctataagatatgatcgagacggtgaaccatcgcagcttactcctgttgacgtgtttgttagtacagtggacccactgaaagagcctcctcttgtaacagcaaacacagttctctcgattcttgctgtggactacccggtagacaaagtagcctgttatgtttcagacgatggtgcagctatgctgacgttcgaatctctttctgaaactgccgagttcgcaaagaaatgggtgccattttgcaagaagtttagcattgaacccagagcccctgagttctattttgcacagaagatagattacttgaaggacaagatccagccttcttttgttaaagaacgacgagctatgaagagagagtatgaagagtttaaggtgaggatcaatgcacttgttgctaaagcacagaagatccctgaagaaggatggacgatgcaggatggtactccctggcctggtaacaacactagagatcatcctggaatgattcaggtgttcttaggccacagtggaggtctagatactgatggaaatgagctgcctaggctcatctatgtttctcgtgaaaagcggcctggatttcaacaccacaagaaggctggagctatgaatgcattgatccgtgtttctgctgttctgaccaatggagcttatctattgaacgtggattgtgatcattacttcaacaacagcaaagctattaaagaagccatgtgtttcctgatggaccctgcttatggaaaaaaatgctgctacgtccagttccctcagcgttttgatggtattgacttgcacgatcgttacgccaacaggaatatagtcttcttcgatattaacttgaaggggttagatggaatccagggtccagtatatgtgggtactggttgctgtttcaataggcaagctctatatgggtatgatcctgttttgactgaggaagatctggaaccaaatattattgtcaagagctgttgtggctcaaggaagaaaggaaagaaaagcaagaagtataactatgatcaacagaggagaggcatcaacagaagtgactccaatgctccacttttcaacatggacgacatagaagagggttttgaaggttatgatgatgagaggtctattctaatgtcccagaagagtgtagagaagcgttttggtcagtccccagtgtttattgcggctaccttcatggaacaaggtggcattccaccaacgaccaatccagctactcttctcaaggaggctattcatgttataagctgtggctacgaggacaagactgaatggggaaaagagattggttggatctatggttctgtgacagaagatattcttactgggttcaagatgcatgcccggggttggatgtccatctactgcaatcctccacgacctgcgttcaagggatctgcaccaatcaatctttctgatcgtttgaaccaagttcttcgatgggcgttgggatctattgagattctcctgagtagacattgccctatctggtatggctatacaggaaggttgagactcttggagagactcgcttacatcaacaccattgtctaccctattacagctctcccactcatcgcctactgtatccttcctgctttttgcctcatcactgacaagttcatcataccagagataagcaactacgcgagtatctggtttattcttctcttcatctcaatcgctgtgactggagttctagagctgagatggagcggcgtgagcattgaggactggtggaggaacgagcagttctgggtcatcggtggaacatctgctcatcttttcgcagtcttccaaggtctactcaaggttcttgcgggtatagacactaacttcactgtcacatccaaagcctcggacgaagatggggatttcgcggagctttacatcttcaaatggacagctcttctcattccaccgaccacagtgctagttgtgaacctcataggcattgtggctggtgtctcttacgctgtgaacagtgggtaccagtcatggggaccgctctttgggaagcttttcttcgccttgtgggtcattgcccatctctaccctttcttgaaaggtctaatgggaagacagaacagaacgccaaccatcgtcatcgtttggtctgttcttctggcctccatcttttcgttgctttgggtcaggatcaatccttttgtctctgtcactcccgaggccaaccccactgccgtcccaggaggtgtcttttagaccctattttatatatattttgtaagcgcatatacggaatgggagcactctctaaatcttctaagcctcaaaaccaagtgaaccaggcggttagttttctcttagcggtcagagagttatgaagttattggtacttgtcaccgttgtgatggtgtctctcttttgaaacatagagccacaagtaatactttgttattattatattatatttattaattttgcttctcacctcaccttgtaatgttggagctttgttgttgtcctaacgagtctatatatgcgctttcactataatacaaaagttttattcaac

SEQ ID NO: 88 - DNA, 3660 bp, Brassica napus
ggatatgatttgttacaatatttaatattattgttttatgaattagaagagtgacaagaggcaaagagcagagacaaatagcagcttacaaatatctctctctcttctagagaaagaatcgcagattcatagagatctgaagagtcacatcacaacgactccatcttcagatctcatgatttgagctaccccgacgattcggtgatcggagaaagtaagcgacgatggaatccgatggagaaaccgcggggaagccgatgacgagcgtcggtgggcagatatgccagatctgcagcgacaatgtcggcaagactgttgacggtgaccgtttcgtggcctgtgatatctgtggattccctgtttgcaggccttgctatgaatacgagaggaagcacgggaatcaatcttgtcctcagtgcaaaaccacttacaagaggcacaagggtagtcctgctattcccggtgataaggatgaggatgtcttcgctgatgaggccaccgttgagctcaactacccgcagaaggagaagatttcggagcggatgcttggatggcatcttacgcgtgggaaaagtgaggagatggggcagcctgagtatgacaaggaggtttctcacaaccatctccctcgtctcaccagtagacaagatacttcaggtgagttttctgctgcctcgcctgaacgtctctctgtgtcttctactatagctggtggaaagcgtcttccctattcatctgatatcaatcaatcaccaaatagaaggatttcggatcctgttggactagggaatgtagcttggaaggagagagttgatggctggaaaatgaagcaggagaagaataatggtggtcctgtgagcacccaggctgcttctgaaagaggtggaggagatattgatgctagcactgatatcctcgcagatgaggctttgctgaatgacgaagcgaggcagcctctgtcaaggaaagtttctattccttcatcacggatcaatccctacaggatggttattatgttgcggcttgttatcctgtgtctcttcttgcactaccgtataacaaatccagtgccaaatgccttcactctgtggctgatctcagtgatatgtgagatctggtttgccttttcctggattttggatcagtttcccaagtggtttcctgtgaaccgtgaaacctacctcgacaggcttgctttaagatatgatcgtgaaggtgagccgtcacagttagctgctgtggacatcttcgtgagtactgttgaccctttgaaggagccacctcttgtgacagccaacacagtgctctctattttggcggttgactacccagttgacaaggtgtcttgctatgtttccgatgatggtgctgccatgttatcatttgaagcacttgcagaaacatcagagtttgctcgtaaatgggtaccattctgcaagaaatatagcattgagcctcgcgcaccagaatggtattttgctgcgaaaatagattacttgaaggataaagttcagacatcatttgtcaaagatcgtagagccatgaagagggagtatgaggaatttaagatccgaatcaatgcacttgtttccaaggccctaaaatgtcctgaagaagggtgggttatgcaagatggtacaccatggcctggaaataatacaagggaccatccaggaatgatccaggttttcttagggcaaaatggtggacttgatgcggagggcaatgagcttccacgtttggtgtatgtttctcgagaaaagagaccaggattccagcaccacaaaaaggctggtgctatgaatgcacttgttagagtttcagcagtacttaccaatggacctttcatcttgaatcttgattgtgatcattacataaataacagcaaggccttgagagaagcaatgtgcttcctgatggacccaaacctagggaagcaagtttgttatgttcagttcccacaaagattcgatggtattgataagaacgatagatatgctaatcgtaataccgtgttctttgatattaacttgagaggtttggatgggattcaaggacctgtatatgtgggaactgggtgtgttttcaacagaacagccttatatggttatgaacctccaataaaagtaaagcacaagaagccaagtctcttatctaagctctgtggtggatcaagaaagaagaattccaaatctaagaaagattcggacaaaaagaaatcaggcaggcatactgactcaactgttcctgtattcaacctcgatgacatagaagagggagttgaaggtgctggttttgacgatgaaaaggcgctcttgatgtcgcaaatgagcctggagaagcgatttggacagtctgctgtttttgttgcttcaaccctaatggaaaatggaggtgttcctcctacagaaactccagaaaaccttctcaaagaggctatccatgtcattagttgtggttacgaggataagtctgattggggaatggagattggatggatctatggttctgtgacagaagatattctaactgggttcaaaatgcatgcccgtggatggagatccatttactgtatgccaaaacttcccgctttcaaggggtctgctcctatcaatctttcagaccgtcttaaccaagtcctgaggtgggctctaggttcggttgagattctcttcagtcggcattgtcctatatggtatggttacagtgggaggcttaagtttcttgagaggtttgcgtatgtgaacacaaccatctacccactcacctccgtccctcttctcttttattgtacattgcccgccgtttgtctcttcaccaaccagttcatcattcctcagatcagtaacattgcaagtatatggtttctgtctctctttctgtctattttcgccacgggtatactcgaaatgaggtggagcggcgtagggatagacgaatggtggagaaacgagcagttctgggtcatcggtggagtatcagctcacttgttcgcggtgtttcaaggtctcctcaaagtcctagctggtatcgacacgaacttcactgtcacgtcaaaggcttcagacgaagacggagacttcgcggagctctacttgttcaaatggacaacgcttctgattcctcccaccacgctgctcatcgtaaacctcgtgggagttgtcgcgggattctcgtatgctatcaacagtggataccagtcgtggggaccgctctttggtaagctgttcttcgccttttgggtgattgttcacttgtacccattcctcaagggtttgatggggagacagaacaggactcctactattgttgtggtctggtctgttctcttggcgtccatcttctccttgttgtgggttaggatcgatcctttcactaaaagagtcactggcccggacattctggaatgtggaatcaactgttgagatgtgagagcaatgatatgcttttgggtggtttaagaaacacataattataaagtttatatttattattgttttatttgtcttgtctattgtctgtttgtgtcgtgtaagattaaagagtatttttgtttatgtgatgaagaagcaagcagtggatatagtttcatgttgtatttttcaagagatagaaaacataaatctattgtttggaatgagaaatcatttagagactttg

SEQ ID NO: 89 - DNA, 3705 bp, Brassica napus
cggaacacacagacacagcgattaaataggcaaaagcagatttgttaaaaaaactcaaatcagacaaagagatacatagagagagagagtgtgtgtgttagtgtgaacatcttcttttgagttcgagagagaggtttttcgagatgccgtattgaatcggccaaagaattgaaattgcaatctctctgtctctgtgtgtttgtgtgtttgtcggtggctcgttgacttcttcactcatcagcgatggaggccagttccggcttggttgctggatcttaccggagaaacgagctcgttcgtatccgtcacgaatctgacggcgggtccaaacctttgaagaatatggaccgtgagatatgccagatctgtggtgaccacgctggtctcaccgaaactggagatctctttgtggcttgcaatgaatgtgccttccctgtgtgtcgtccttgctatgattacgagaggaaagatggaactcagtgctgccctcactgcaagactagatacagacggctcaggggtcatcctcgtgttgaaggagatgaggatgaggatgatgttgatgatatcgagaatgagttcagctacgcccagggaggagctaacaagccgagacgccgtgaagagttttcctcctcctctagacatgattctcagccaattcctcttctcacccatggccatggggtttctggagagattcggacgcctgatacacaatctgtgcgaactacatcaggtcctttggggcctggtgagaggaacgccatttcatcttcatatattgacccacgccaacctgtccctgtaaggatcgtggacccgtcaaaagacttgaactcttacgggcttggaaacgttgactggaaagaaagagttgaaggctggaagctgaaacaggagaagaacatgttacagatgactggtaaatatcatgaagggaaaggaggagagattgaagggactggttccaatggcgaagaactccaaatggctgatgatacgcgacttcctatgagccgtattgtgcctatcccgccttctcatctcacaccttatcgtgttgtgattattctccggcttatcatcttgggattcttcttgcaataccgtacaactcaccctgtgaaagatgcatatccgttgtggttgacttcagttatttgtgagatctggtttgcattctcttggcttcttgatcagtttcccaaatggtaccccattaacagagagacttatcttgaccgtctcgctataagatatgatcgagagggtgaaccatctcagcttactcctgttgatgtgtttgttagtacggtggacccactgaaagagccacctcttgtaacggcaaacacagttctctcgattcttgccgtggactacccggtagataaagtagcctgttatgtttcagatgatggtgcagcgatgcttaccttcgaatctctttctgaaactgctgagttcgcaaagaaatgggtgcctttttgcaagaaattcagcattgaacccagggctcctgaattctattttcagcagaagatagattacctgaaggacaagatccagccttcttttgttaaagagcgacgagctatgaagagagagtatgaggagtttaaggtgaggatcaatgcacttgttgctaaagcacagaaaatccctgaagaaggctggacgatgcaggatggtactccctggcctggtaacaacactagagatcatcctggaatgatccaggtgttcttaggccacagtggaggtctagataccgatggaaatgagctgcctagactcatctatgtttctcgtgaaaagcggcctggattccagcatcacaaaaaggctggagctatgaatgccttgatccgtgtttctgctgttcttaccaatggagcatatcttttgaacgtggactgtgatcattacttcaacaacagcaaggctattaaagaagccatgtgtttcttgatggaccctgcttacggaaagaagtgctgctatgtccagttcccacagcgtttcgatggtattgatttgcacgatcgatatgccaacaggaatattgtcttcttcgatattaacttgaaggggttagatggtatccaaggtccagtatatgtgggtactggatgttgtttcaacaggcaagctctatatggatatgatcctgtcttgacagaggaagatttaaaaccaaacatcattgtcaagagctgctgcggctcaaggaagaaaggaaagaacagtaagaaatatagctatgatcaaaaaaggagaggcatcagcagaagtgattccaatgctccacttttcaacatggacgacatcgatgagggtttcgaaggatatgatgatgataggtctattctaatgtcccagaagagtgtggagaagcgttttggtcagtcgccagtatttattgctgccacgtttatggaacaaggtggcattccaccaacgaccaatccagctactcttctcaaggaggctattcatgttataagctgtggttacgaggacaagactgagtggggaaaagagattggttggatctatggttctgttacagaagatattcttactggattcaagatgcatgctcgtggttggatgtctatctactgcaatcctccacgacctgcgttcaagggatctgcaccaatcaatctttctgatcgtttgaaccaagttcttcggtgggcgttgggatctatcgagattcttctgagtagacattgccctatctggtatggctatacaggaaggttgagactcttggagaggctcgcttacatcaacaccattgtctaccctattacagctctccctctcatcgcctattgtattcttccagctttttgcctcatcactgacaagttcatcatacctgagataagcaactacgcgagtatttggttcattcttctcttcatctccattgctgtgactggaatcctggagctgagatggagcggtgtgagcattgaggactggtggagaaacgagcagttctgggtcattggaggcacatctgctcatctttttgcagtcttccaaggtctactcaaggtacttgcgggcatcgacactaacttcaccgtcacatcaaaagcctcagacgaagatggggacttcgcagagctttacatcttcaaatggacagctcttctcattccaccaaccacggtcctagttgtgaacatgataggcattgtggctggtgtctcttacgctattaacagcgggtaccagtcatggggtccgctctttgggaagcttttcttcgccttgtgggtcattgcccatctctacccgttcttgaaaggtctgcttggaagacagaacagaacaccaaccatcgtcattgtttggtctgttcttctcgcctccatcttttcgttgctttgggtcaggatcaatccatttgtctctgtcactccagctgccaaccccaatgccgtccctggtggtgtcttttagaccctatttttatatacattttgtgtgcatattatggtgaaaccgagcggttatggtgatgcagtgttagctttctctgtgtagcaagagagttatgaaactgttggtggctgtcattgttgtgatgatcttaattattttggtatgttatagtttttccagtggagaagatgtgtaaaccaaatgatacataagtctacaaaagataatctttaattc

SEQ ID NO: 90 - DNA, 3255 bp, Glycine max
atggaagcaagtgcgggaatggttgccggttcgcataaacggaacgagctcgttcggattcgccacgattcttctgacagcgggtctaaacccatgaagaatttgaatgggcaaatctgtcaaatatgcggtgatactgttggattaactgctactggtgatgtgtttgttgcttgcaacgagtgtgctttccctgtgtgtcgtccttgttatgaatatgagcggaaggatgggaaccagtcttgtccacagtgcaagactagatacaagaggcacagagggagtcctcgagttgagggtgatgaagatgaagatgattctgatgatatcgagaatgagttcaattatgcccaaggaaaagccaaggccaggcggcagtgggaagacgatcctgacctgtcgtcgtcttctagacgtgaatctcaacagccaattcccctcctcaccaatggccaaacgatgtctggtgagattccatgtgccacacctgatactcaatctgtgcgaactacttcaggtcctctgggcccatctgaaaaggttcactcacttccctatgttgatccaaggcaaccagttccagtaagaattgtggacccatcaaaggacttgaattcttatggtctgggaaatgttgactggaaagaaagggttgaaggttggaagcttaagcaggagaaaaatatggtgcaaatgactggtagatacgctgaagggaaaggtggagatgttgaagggactggttctaatggagaagaacttcaaatggtagatgatgctcgacaacctatgagtcgtgttgtgccaattccttcatctcagctgacgccttatcgtgttgttatcatcctccggctgattattcttggcttcttcttacaatatcgtgtaactcatcctgtgaaagatgcatacccactgtggttgacatcagttatttgtgagatttggtttgccttatcctggctcttggatcagtttccaaaatggtctcccattaatcgtgagacttatcttgaacggcttgctttaaggtatgatcgtgaaggagaaccatcacagttagatcctgttgatgtgtttgttagtacagtggatcccctcaaagagccacctcttgttactgcaaacaccgttttgtctatactttctgttgattaccctgtcgacaaagtttcctgctatgtatcagatgatggttcagctatgttgacctttgaagcactatctgaaacagctgagtttgcgaagaagtgggtgcccttttgcaaaaagcacaatattgaaccaagagccccagagttttattttgcccagaagattgattacttaaaggacaagattcagccctcgtttgtaaaagagcgacgggcaatgaagagagaatatgaagaattcaaagtacggatcaatgcccttgtagccaaagctcagaagatgccagaggaaggttggacaatgcaggatggaactccttggcctggaaataatcctagggatcatccgggaatgattcaggtgtttttaggtcatagtggggggctggatacagatggaaatgagctgcctagacttgtttatgtttctcgtgagaagcgaccaggcttccaacatcacaagaaggctggagctatgaatgctttgattcgagtttctgctgtcttgaccaatggtgcatatcttctgaatgtggattgtgatcactatttcaataatagcaaagccctcaaagaagccatgtgtttcatgatggatcctgttcttggaaagaagacatgctatgttcaatttcctcagagatttgacggcattgacttgcacgatcgatatgccaatcgcaatattgtgttctttgatatcaacatgaaaggtcaggatggtgttcagggcccagtctatgtgggaactggttgttgtttcaataggcaagctttgtatggttatgatcctgttttgactgaggaagatttggaacctaacattattgtaaagagttgttgcggttctagaaagaagggaaagggtggcaataagaagtacagtgacaagaagaaggcgatgggaagaactgaatccactgtacccatatttaatatggaagacatagaggagggtgttgaaggttatgatgatgaaaggacactacttatgtctcaaaagagcttggagaagcgttttggtcagtctccagtttttattgctgccactttcatggagcagggtggcattccaccttcaacgaaccctgcaactcttcttaaggaagcaatccatgttatcagctgtggttacgaagacaagacagaatggggcaaagagattggatggatctatggctctgtgacagaagatatcttgactgggttcaagatgcatgctcgtggttggatttccatctattgcatgccacctcgcccagcatttaagggttctgctcctatcaatctttctgatcgtctcaatcaggtgcttcggtgggccttgggttcaattgagatctttctaagcaggcattgtcccttgtggtatggctacaatgggaagttgaagcctctgatgaggcttgcttatattaacaccattgtctacccgtttacctcaatcccattgattgcttactgtacgcttcctgcattttgtcttctcacaaataaatttattattcctgagataagcaactttgccagtatgtggttcattcttctctttgtctccatttttaccacttcaattcttgagcttaggtggagtggggtcagtatagaagactggtggagaaatgaacagttctgggttatcggtgggacatctgcgcatctctttgctgtgttccaggggcttctaaaagtgcttgctgggatcgatacaaattttactgttacatcgaaggcatcggacgaggatggggactttgccgagctttatgtgtttaaatggacatcacttctcatccctcctacaacagtgcttattgtgaatttggttgggattgtggctggtgtatcctatgccataaacagtggttaccagtcttggggtccactatttggcaagctgttctttgctatctgggtcattgcccatctatacccattcttgaagggtctcttgggcaggcaaaatcgtaccccaaccattgttattgtttggtccgttcttcttgcttcaatattctccttgctgtgggtgaggattgatcccttcacctctgactccaacaaattaaccaatggtcaatgtggcatcaactgttag

SEQ ID NO: 91 - DNA, 3225 bp, Glycine max
atgatggagtcagaaggagaagctggggcaaagccaatgaaaacattgggtggcaaaatctgccagatctgtggtgataatattgggaacaatgcgaatggcgatcctttcattgcctgcgatgtttgcgctttccctgtctgcagggcgtgctatgaatatgaaaggaaggatggaaatcagtcttgccctcagtgcaagacccggtacaagaggcacaaaggaagtcctgcaattcttggagaccgagaagaggatgggggtgctgatgatggtgccagtgacttcaattacaattcagagaatcagaatgaaaagcagaagattgagcatatgttgggctggcaaatggcatatgggcgtgcagaggaggccattgctccgaattatgataaggaagtttctcacaatcacattcctctgctctccggtggacaagaggtttctggagaattatctgctgcctcacctgagaggctgtcaatggcatccccaggtggccgagggaagcgtgcccataatcttcaatattcgtctgaccttaatcattcaccaaatatcagggttggggatcctggattgggcaatgtggcatggaaagaaagagttgatggctggaaaatgaagcaagataagaatgttgctccaatgagcacgggccaagctacttctgaaagaggagctggagatattgatgctagtactgatgtgcttgtggacgattccttgttgaatgatgaggctcggcaacccctctctaggaaggtttctattccatcatctaggatcaatccataccgtatggtcattgctctgcggttggttatcctatgcatttttctgcattatcgaataacaaatcctgtgcccaatgcatatgcattgtggttgatatcagttatatgtgagatttggtttgccatatcttggatattggatcaattccccaagtggctccctgtgaaccgtgaaacatatcttgacagacttgcactaagatatgatcgggaaggggaaccatcacagctagcagctgttgacatttttgtcagtactgttgatccattaaaagaacccccgcttgtgactgctaacactgtcctatctattctttctgttgactacccagtggataaggtctcctgttatgtctctgatgatggtgctgctatgttgacatttgaagctctggctgagacatcagaatttgctaggaaatgggttcctttcagcaagaaatataatatcgaacctcgggcacctgagtggtattttgcacagaagattgactacttgaaagataaggttcaaccatcatttgtcaaagatcgtagagcaatgaagagagaatatgaagaatttaaaattcgcatcaatggacttgttgcaaaggcacaaaagattcctgaagaaggatgggtgatgcaagatggtacgccatggcctggaaacaacactagagaccatccaggaatgattcaggttttcttgggccaaagtggaggacttgacactgagggtaatgaacttccacgtttagtctatgtttctcgtgaaaagcgtccagggttccaacatcacaagaaggctggtgccatgaatgcacttgttcgagtgtcagcagtccttactaatggacctttcttattgaatcttgattgtgatcactacataaacaacagtaaagccttgagggaagctatgtgctttatgatggatcccaaccttgggaaaaatgtttgctatgtccagtttccacagaggtttgatggtattgataggaatgatcgatatgccaatcgcaatactgttttctttgatataaacttgagaggtttggatggcattcaaggtcctgtttatgtgggtactggatgtgtctttaatagaacagctttgtatggctacgaacctcctattaaacccaagcataaaaagcctgggtttctttcttcactctgtggtggtaaccgaaagaagagatcaaaatctagcaagaaaggctcagacaagaaaaaatctagcaagaatgttgacccaactgtgcccatctttagtcttgaggatatagaagagggggtggaaggtgctggatttgatgatgagaaatcactacttatgtcacaaatgagcctcgagaaaaggtttggtcagtctgctgtctttgttgcctctacactcatggagaatggtggcgttcctcagtctgcaactccagaaactcttcttaaggaagctattcatgttatcagttgtggttacgaggataaatcagaatggggaagtgagataggatggatctatggttctgtcacagaagatattcttactggattcaagatgcatgcccgaggttggaggtctatttactgcatgcccaagctcccagcgtttaaaggttctgctcctatcaatctttcagatcgtctgaaccaagtgcttcgatgggctttaggttcggtggaaattctttttagtcgacattgtcccatctggtatggttatagtggaaggctaaagtggctcgagaggttcgcatatgtgaacaccacaatctatccagtcacttccattccccttctcatgtattgtaccttacctgctgtctgtctcctgactaacaagttcattattccacagattagtaacattgcaagtatatggtttatctctctctttctttccatctttgccacgggtatccttgagatgaggtggagtggtgttggaattgatgagtggtggagaaatgaacaattttgggttatcggtggtgtctcggcccatctttttgccgtgttccaaggtttactcaaagtgcttgctggaattgacactaacttcactgttacctcaaaagcatcagatgaggatggagactttgcagaactctacatgttcaaatggacaacccttctcatcccacccacgacgcttctcatcataaacctggtgggggttgttgcaggcatctcctatgccatcaacagtggctaccaatcatggggtcccctctttggtaagcttttctttgcattttgggtgatcatccatctctaccctttcctcaaaggtctcatgggtcgccagaacagaacaccaaccattgtggtggtctggtccattcttcttgcatctatcttctctctgttgtgggtccgaattgacccgtttacgacaagagtcactggtcctgatgttgagcagtgtggaatcaactgctag

SEQ ID NO: 92 - DNA, 3240 bp, Glycine max
atggaatcagaaggggaagctggggcaaagccagtgacagcattgggtgcccaagtgtgccagatttgtggtgatggtgttgggaagactgtggatggtgaaccgttcgttgcgtgcgatgtttgcgctttccctgtctgcaggccttgctatgagtatgagaggaaggatgggaatcaatcttgcccccagtgcaaaacccggtacaagaggcacaagggaagtcctgcaattcttggagacatggaagaggatggtgctgctgctgctgatgccagtgacttcaattatgattcagaaaatcaaaatcaaaatcaaaaccaaaagcagaagatttcagagcgcatgttaagctggcaattgacatacccacgaggagaggaggttggtgctccaaattatgataaggatgtttctcacaaccacattcctctgctgaccagtggacaagaggtatctggagagttgtctgcagcctcacctgagaggctctcaatggcatctcctgcagttggtggtggaaagcgtgtccataatattccatattcatctgacattaatcaatctccaaatatcagggctggggatccaggattgggcaatgttgcatggaaagaaagagttgatggctggaagatgaagcaagaaaagaatgttgttccaatgagcacaggccaggctgcttctgaaagaggagctggagatattgatgctagtactgatgtgcttgtagatgattctttattgaatgatgaagctcgacagcctctttccaggaaggtttctattccatcttctaggataaatccatatcgtatggtcattatgctgcggctggttatcctttgcattttcttgcattatcggataacaaatcctgttcccaatgcatatccattgtggttggtatcagttatatgtgagatttggtttgccatatcttggatattggatcaatttcccaagtggcttcctgtaaaccgtgaaacatatcttgacaggcttgcactgaggtatgatcgggaaggagaaccgtcacaactagctgctgttgacatttttgtcagtactgttgatccattaaaggagcctccacttgtgactgccaataccgtactatctattcttgcagttgactatccagtggataaggtctcctgctatgtgtctgatgatggtgctgctatgttgacatttgaagcacttgctgagacatcggaatttgcaaggaaatgggttccttttagcaagaagtatagcattgaaccccgtgcgcctgagtggtatttttctcaaaagattgactacttgaaagataaggttcatccatcatttgtcaaggatcgtagagcaatgaagagagaatatgaggaatttaaagttcgtattaatggacttgtttcaaaggcacagaaagttcctgaagaaggatgggttatgcaagatggtaccccgtggcctggaaataacaccagagaccatccaggaatgatccaggttttcttgggccaaagtggaggacttgacactgagggtaatgaacttccacgtttagtctatgtttctcgtgaaaagcgtccagggttccaacatcacaagaaagctggtgccatgaatgcccttgttcgagtatctgcagtccttaccaatggacctttcttattgaatcttgattgtgatcactacataaacaacagcaaggccttgagggaagctatgtgctttatgatggatcccaatcttggtaaacatgtttgctatgtccagtttccgcagaggtttgacggtattgataggaatgatcgatatgccaatcgtaatacagttttctttgatataaacttgagaggtttggatggcattcaaggtcctgtttatgtgggtactggatgtgtcttcaacaggacagctttatatggttatgaacctcctcttaaacccaagcataaaaagcctgggttgttatcatcactctgtggtggaactcggaagaagagttcaaaatctagtaagaaaggatcagacaagaaaaaatctagcaagcatgttgacccaactgtgcccattttcaatttagaggatatagaagaaggagtagaaggtactggatttgatgatgagaaatcactacttatgtcacaaatgagtcttgagaaaaggtttggtcagtccgctgtctttgttgcctctacgcttatggagaatggtggtgttcctcaatctgctactccagaaactcttcttaaggaggctattcatgttatcagctgtggttacgaggataaaactgattggggaagtgagataggatggatttatggttctgtcacagaagatattcttaccggatttaagatgcatgcccggggttggcggtctatatactgcatgcctaagcgcccagcgtttaaaggttctgctcccatcaatctttcggatcgtctaaaccaagtgcttcgatgggctttaggttccgtggaaattcttttcagccgacactgtcccatctggtatggttatggtggaaggttaaagtggcttgaaaggtttgcttatgtgaacaccaccatctatccagtcactgccattccccttctcatttattgtatcttgcctgctgtctgtctgctgactaataagttcattattccacagatcagcaaccttgctagcatatggttcatctccctctttctgtccatctttgctactggaatcctggagatgaggtggagtggtgtcggaatcgacgagtggtggaggaatgaacagttttgggtcatcggtggtgtctcggcacatctctttgctgttttccaaggcttgctcaaagtgcttgctggaattgacaccaacttcactgtcacctccaaggcctcggatgaagacggagactttgccgaactatacatgttcaaatggaccacccttcttattcctccaacaacccttctcataataaacttggtgggggtggttgctggcatctcctatgccatcaacagtggctaccaatcttggggacccctctttggtaagcttttctttgcattttgggtgatcatccatctataccctttcctcaaaggtctcatggggcgccaaaacagaacaccaaccattgtggtggtgtggtccgttctgcttgcatccattttctcactcttgtgggttagaattgatccattcaccacaagggtcactggtcctgatgttgaggagtgtggcattaactgctag

SEQ ID NO: 93 - DNA, 3228 bp, Zea mays
atggcggccaacaaggggatggtggcgggctcgcacaaccgcaacgagttcgtcatgatccgccacgacggcgatgcgccgggctcggctaagcccacaaagagtgcgaatgggcaggtctgccagatttgtggtgactctgtgggtgtttcagccactggtgatgtctttgttgcctgcaatgagtgtgccttccctgtctgccgcccatgctatgagtatgagcgcaaggaggggaaccaatgctgcccccagtgcaagactagatacaagagacagaaaggtagccctcgagttcatggtgatgaggatgaggaagatgttgatgacctagacaatgaattcaactacaagcaaggcaatgggaaaggcccagagtggcaactgcaaggagatgatgctgatctgtcttcatctgctcgccatgagccacatcatcggattccacgcctgacaagcggtcaacagatatctggagagattcctgatgcttcccctgaccgtcattctatccgcagtccaacatcgagctatgttgatccaagcgtcccagttcctgtgaggattgtggacccctcgaaggacttgaattcctatgggcttaatagtgttgactggaaggaaagagttgagagctggagggttaaacaggacaaaaatatgatgcaagtgactaataaatatccagaggctagaggaggagacatggaggggactggctcaaatggagaagatatgcaaatggttgatgatgcacggctacctttgagccgtatcgtgccaatttcctcaaaccagctcaacctttaccgggtagtgatcattctccgtcttatcatcctgtgcttcttcttccagtatcgtgtcagtcatccagtgcgtaatgcttatggattatggctagtatctgttatctgcgaggtctggtttgccttgtcttggcttctagatcagttcccaaaatggtatccaatcaaccgtgagacatatcttgacaggcttgcattgaggtatgatagagagggagagccatcacagctggctcccattgatgtcttcgtcagtacagtggatccattgaaggaacctccactgatcacagccaacactgttttgtccattctttctgtggattaccctgttgacaaagtgtcatgctatgtttctgatgatggttcagctatgctgacttttgagtctctctcagaaaccgcagaatttgctagaaagtgggttcccttttgtaagaagcacaatattgaaccaagagctccagaattttactttgctcaaaaaatagattacctgaaggacaaaattcaaccttcatttgttaaggaaagacgcgcaatgaagagggagtatgaagaattcaaagtaagaatcaatgcccttgttgccaaagcacagaaagtgcctgaagaggggtggaccatggctgatggaactgcatggcctgggaataatcctagggaccatcctggcatgattcaggttttcttggggcacagtggtgggctcgacactgatggaaatgagttaccacgtcttgtctatgtctctcgtgaaaagagaccaggctttcagcatcacaagaaggctggtgcaatgaatgcgctgattcgtgtatctgctgtgctgacaaatggtgcctatcttctcaatgtggattgcgaccattacttcaatagcagcaaagctcttagagaagcaatgtgcttcatgatggatccggctctaggaaggaaaacttgttatgtacaatttccacagagatttgatggcattgacttgcacgatcgatatgctaatcggaacatagttttctttgatatcaacatgaaaggtctggatggcattcagggtccagtttacgtgggaacaggatgctgtttcaatagacaggctttgtatggatacgatcctgttttgactgaagctgatctggagccaaacattgttattaagagctgctgtggtagaaggaagaaaaagaacaagagttatatggatagtcaaagccgtattatgaagagaacagaatcttcagctcccatcttcaatatggaagacatcgaagagggtattgaaggttatgaggatgaaaggtcagtgcttatgtcccagaggaaattggagaaacgctttggtcagtctcctattttcattgcatccacctttatgacacaaggtggcataccaccttcaacaaacccagcttctctactaaaggaagctatccatgtcatcagttgtggatatgaggacaaaactgaatggggaaaagagattggctggatctatggttcagtaacggaggatattctgactgggtttaaaatgcatgcaaggggctggcaatcaatctactgcatgccaccacgaccttgtttcaagggttctgcaccaatcaatctttccgatcgtcttaatcaggtgctccgttgggctcttgggtcagtggaaattctgcttagtagacattgtcctatctggtatggttacaatggacgattgaagcttttggagaggctggcttacatcaacactattgtatatccaatcacatccattccgcttattgcctattgtgtgcttcccgctatctgcctccttaccaataaatttatcattcctgagattagcaattatgctgggatgttcttcattcttcttttcgcctccatttttgccactggtatattggagcttagatggagtggtgttggcattgaagattggtggagaaatgagcagttttgggttattggtggcacctctgcccatctcttcgcagtgttccagggtctgctgaaagtgttggctgggattgataccaacttcacagttacctcaaaggcatctgatgaggatggcgactttgctgagctatatgtgttcaagtggaccagtttgctcattcctccgaccactgttcttgtcattaacctggtcggaatggtggctggaatttcttatgccattaacagtggctaccaatcctggggtccgctctttggaaagctgttcttctcgatctgggtgatcctccatctctaccccttcctcaagggtctcatgggaaggcagaaccgcacaccaacaatcgtcattgtctggtccatccttcttgcatctatcttctccttgctgtgggtgaagatcgatcctttcatctccccgacacagaaagctgctgccttggggcaatgtggcgtcaactgctga

SEQ ID NO: 94 - DNA, 3225 bp, Zea mays
atggcggccaacaaggggatggtggcaggctctcacaaccgcaacgagttcgtcatgatccgccacgacggcgacgcgcctgtcccggctaagcccacgaagagtgcgaatgggcaggtctgccagatttgtggcgacactgttggcgtttcagccactggtgatgtctttgttgcctgcaatgagtgtgccttccctgtctgccgcccttgctatgagtacgagcgcaaggaagggaaccaatgctgccctcagtgcaagactagatacaagagacagaaaggtagccctcgagttcatggtgatgatgaggaggaagatgttgatgacctggacaatgaattcaactataagcaaggcaatgggaagggcccagagtggcagcttcaaggagatgacgctgatctgtcttcatctgctcgccatgacccacaccatcggattccacgccttacaagtggacaacagatatctggagagatccctgatgcatcccctgaccgtcattctatccgcagtccaacatcgagctatgttgatccaagcgttccagttcctgtgaggattgtggacccctcgaaggacttgaattcctatgggcttaatagtgttgactggaaggaaagagttgagagctggagggttaaacaggacaaaaatatgttgcaagtgactaataaatatccagaggctagaggagacatggaggggactggctcaaatggagaagatatgcaaatggttgatgatgcacgcctacctttgagccgcattgtgccaatttcctcaaaccagctcaacctttaccggatagtaatcattctccgtcttatcatcctgtgcttcttcttccaatatcgtatcagtcatccagtgcgtaatgcttatggattgtggctagtatctgttatctgtgaggtctggtttgccttgtcctggcttctagatcagttcccaaaatggtatccaatcaaccgtgagacatatctcgacaggcttgcattgaggtatgatagagagggagagccatcacagctggctcccattgatgtctttgtcagtacagtggatccattgaaggaacctccactgatcacagccaacactgttttgtccattcttgctgtggattaccctgttgacaaagtgtcatgctatgtttctgatgatggctcagctatgctgacttttgagtctctctctgaaactgccgaatttgctagaaagtgggttcccttttgtaagaagcacaatattgaaccaagagctccagaattttactttgctcaaaaaatagattacctgaaggacaaaattcaaccttcatttgttaaggaaagacgagcaatgaagagagagtatgaagaattcaaaataagaatcaatgcccttgttgccaaagcacagaaagtgcctgaagaggggtggaccatggctgatggaactgcttggcctgggaataaccctagggaccatcctggcatgattcaggtgttcttggggcacagtggtgggcttgacactgatggaaatgaattaccacgtcttgtctatgtctctcgtgaaaagagaccaggctttcagcatcacaagaaggctggtgcaatgaatgcactgattcgtgtatctgctgtgctgacaaatggtgcctatcttctcaatgtggattgtgaccattacttcaatagcagcaaagctcttagagaagcaatgtgcttcatgatggatccagctctaggaaggaaaacttgttatgtacaatttccacaaagatttgatggcattgacttgcacgatcgatatgctaataggaacatagtcttctttgatatcaacatgaaaggtctagatggcattcagggtccagtctatgtgggaacaggatgctgtttcaataggcaggctttgtatggatatgatcctgttttgactgaagctgatctggaacctaacattgttgttaagagctgctgtggtagaaggaagagaaagaacaagagttatatggatagtcaaagccgtattatgaagagaacagaatcttcagctcccatctttaacatggaagacatcgaggagggtattgaaggttatgaggatgaaaggtcagtgcttatgtcccagaggaaattggagaaacgctttggtcagtctccaatcttcattgcatccacctttatgactcaaggtggcataccaccttcaacaaacccagcttctctactgaaggaagctatccatgttatcagctgtgggtacgaggacaaaactgaatggggaaaagagattggctggatctatggttcagttacagaggatattctgactgggtttaaaatgcatgcaagaggctggcaatcaatctactgcatgccaccacgaccttgtttcaagggttctgcaccaatcaatctttctgatcgtcttaatcaggtgctccgttgggctcttgggtcagtggaaattctgcttagcagacattgtcctatatggtatggctacaatgggcgattgaagcttttggagaggctggcttacattaacaccattgtttatccaatcacatctgttccgcttatcgcctattgtgtgcttcctgctatctgtcttcttaccaataaatttatcattcctgagattagtaattatgctggaatgttcttcattcttctttttgcctccattttcgcaactggtatattggagctcagatggagtggtgttggcattgaagattggtggagaaatgagcagttttgggttattggtggcacctctgcccatctcttcgcggtgttccagggtctgctgaaagtgttggctgggattgataccaacttcacagttacctcaaaggcatctgatgaggatggcgactttgctgagctatatgtgttcaagtggaccagtttgctcatccctccgaccactgttcttgtcattaacctggtcggaatggtggcaggaatttcgtatgccattaacagcggctaccaatcctggggtccgctctttggaaagctgttcttctcgatctgggtgatcctccatctctaccccttcctcaagggtctcatgggcaggcagaaccgcacgccaacaatcgtcatcgtttggtccatcctccttgcgtctatcttctccttgctgtgggtgaagatcgatcctttcatctccccgacacagaaagctgccgccttggggcaatgtggtgtgaactgctga

SEQ ID NO: 95 - DNA, 3240 bp, Zea mays
atggagggcgacgcggacggcgtgaagtcggggaggcgcgggggagggcaggtgtgccagatctgcggcgatggcgtgggcactacggcggagggagacgtcttcaccgcctgcgacgtctgcgggttcccggtgtgccgcccctgctacgagtacgagcgcaaggacggcacacaagcgtgcccccagtgcaaaaacaagtacaagcgccacaaggggagtccagcgatccgaggggaggaaggagacgatactgatgccgatgatgctagcgacttcaactaccctgcatctggcaatgacgaccagaagcagaagattgctgacaggatgcgcagctggcgcatgaatgctgggggcagcggggatgttggccgccccaagtatgacagtggtgagatcgggcttaccaagtacgacagtggtgagatccctcggggatacatcccgtcagtcactaacagccagatttcgggagaaatccctggtgcttcccctgaccatcatatgatgtctcctactgggaacattggcaggcgcgccccatttccctatatgaatcattcatcaaatccgtcgagggaattctctggtagcgttgggaatgttgcctggaaagagagggttgatggctggaaaatgaagcaggacaagggaacaattcccatgacgaatggcacaagcattgctccctctgagggccggggtgttggtgatattgatgcatcaactgattacaacatggaagatgccttattaaacgatgaaactcgccagcctctatctaggaaagttccacttccttcctccaggataaatccatacaggatggtcattgtgctacgattgattgttctaagcatcttcttgcactaccggatcacaaatcctgtgcgtaatgcatacccactgtggcttctatctgttatatgtgagatctggtttgctctttcctggatattggatcagtttccaaagtggtttccaatcaaccgcgagacttaccttgatagactcgcattaaggtatgaccgggaaggtgagccatctcagttggctgctgttgacatttttgtcagtactgtcgacccaatgaaggagcctcctcttgtcactgccaataccgtgctatccattctcgctgtggactatcctgtggataaggtctcttgctatgtatctgatgatggagctgctatgctgacatttgatgcactagctgagacttcagagtttgctagaaaatgggtgccatttgttaagaagtacaacattgaacctagagctcctgaatggtacttctcccagaaaattgattacttgaaggacaaagtgcacccttcatttgttaaagaccgccgggccatgaagagagaatatgaagaattcaaaattagggtaaatggccttgttgctaaggcacaaaaagtccctgaggaaggatggatcatgcaagatggcacaccatggccaggaaacaataccagggaccatcctggaatgattcaggttttccttggtcacagtggtggtcttgatactgagggtaatgagctaccccgtttggtctatgtttctcgtgaaaaacgtcctggattccagcatcacaagaaagctggtgccatgaatgctcttgtccgcgtctcagctgtgcttaccaatggacaatacatgttgaatcttgattgtgatcactacatcaacaacagtaaggctctcagggaagctatgtgcttccttatggatcctaacctaggaaggagtgtctgctatgttcagtttccccagaggttcgatggtattgataggaatgatcgatatgccaacaggaacaccgtgtttttcgatattaacttgagaggtcttgatggcatccaaggaccagtttatgtgggcactggctgtgttttcaacagaacagctctatatggttatgagcccccaattaagcaaaagaagggtggtttcttgtcatcactatgtggtggcaggaagaagggaagcaaatcaaagaagggctcagacaagaaaaagtcacagaagcatgtggacagttctgtgccagtattcaatcttgaagatatagaggagggagttgaaggcgctggatttgatgatgagaaatcacttcttatgtctcaaatgagcttggagaagagatttggccaatctgcagcttttgttgcgtccactctgatggaatatggtggtgttcctcagtctgcgactccagaatctcttctgaaagaagctatccatgtcataagttgtggctacgaggacaagactgaatggggaactgagattgggtggatctatggttctgtgacggaagatattctcactgggttcaagatgcacgcacgaggctggcggtcgatctactgcatgcctaagcggccggccttcaagggatcggctcccatcaatctctcagaccgtctgaaccaggtgctccggtgggctctcggttcagtggaaatccttttcagccggcattgccccctatggtacggctacggaggacgcctgaagttcttggagagattcgcctacatcaacaccaccatctacccgctcacgtccctcccgctcctcatttactgtatcctgcctgccatctgcctgctcacggggaagttcatcatcccagagatcagcaacttcgctagtatctggttcatctctctcttcatctcgatcttcgccacgggtatcctggagatgaggtggagcggcgtgggcatcgacgagtggtggaggaacgagcagttctgggtcatcggaggcatctccgcccacctcttcgccgtcttccagggcctcctcaaggtgcttgccggcatcgacaccaacttcaccgtcacctccaaggcctcggatgaagacggcgacttcgcggagctgtacatgttcaagtggacgacacttctgatcccgcccaccaccatcctgatcatcaacctggtcggcgttgttgccggcatctcctacgccatcaacagcgggtaccagtcgtggggtccgctcttcggcaagctcttcttcgccttctgggtgatcgttcacctgtacccgttcctcaagggtctcatgggtcggcagaaccgcaccccgaccatcgtggttgtctgggcgatcctgctggcgtcgatcttctccttgctgtgggttcgcatcgatccgttcaccacccgcgtcactggcccggatactcgaacgtgtggcatcaactgctag

SEQ ID NO: 96 - DNA, 3234 bp, Zea mays
atggagggcgacgcggacggcgtgaagtcggggaggcgcggtggcggacaggtgtgccagatctgcggcgacggcgtgggcaccacggcggagggggacgtcttcgccgcctgcgacgtctgcgggtttccggtgtgccgcccctgctacgagtacgagcgcaaggacggcacgcaggcgtgcccccagtgcaagaccaagtacaagcgccacaaggggagcccggcgatccgtggggaggaaggagacgacactgatgccgatagcgacttcaactaccctgcatctggcaatgaagaccagaagcagaagattgccgacagaatgcgcagctggcgcatgaacgctgggggcagcggggatgttggtcgccccaagtatgacagtggcgagatcgggcttaccaagtatgacagtggcgagatccctcggggatacatcccatcagtcactaacagccagatctcaggagaaatccctggtgcttcccctgaccatcatatgatgtccccaactgggaacattggcaagcgtgctccatttccctatgtgaaccattcgccaaatccgtcaagggagttctctggtagcattgggaatgttgcctggaaagagagggttgatggctggaaaatgaagcaggacaaggggacgattcccatgacgaatggcacaagcattgctccctctgagggtcggggtgttggtgatattgatgcatcaactgattacaacatggaagatgccttattgaacgacgaaactcgacagcctctatctaggaaagttccacttccttcctccaggataaatccatacaggatggtcattgtgctgcgattgattgttctaagcatcttcttgcactaccgtatcacaaatcctgtgcgcaatgcatacccattatggcttctatctgttatatgtgagatctggtttgctctttcgtggatattggatcagttccctaagtggtttccaatcaaccgggagacgtaccttgataggctggcattaaggtatgaccgggaaggtgagccatctcagttggctgctgttgacattttcgtcagtacagtcgacccaatgaaggagcctcctcttgtcactgccaataccgtgctatccattcttgctgtggattaccctgtggataaggtctcttgctatgtatctgatgatggagctgcgatgctgacatttgatgcactagctgagacttcagagtttgctagaaaatgggtaccatttgttaagaagtacaacattgaacctagagctcctgaatggtacttctcccagaaaattgattacttgaaggacaaagtgcacccttcatttgttaaagaccgccgggccatgaagagagaatatgaagaattcaaagttagggtaaatggccttgttgctaaggcacagaaagttcctgaggaaggatggatcatgcaagatggcacaccatggccaggaaacaataccagggaccatcctggaatgattcaggttttccttggtcacagtggtggccttgatactgagggcaatgagctaccccgtttggtctatgtttctcgtgaaaagcgtcctggattccagcatcacaagaaagctggtgccatgaatgctcttgttcgtgtctcagctgtgcttaccaatggacaatacatgttgaatcttgattgtgatcactacattaacaacagtaaggctctcagggaagctatgtgcttccttatggaccctaacctaggaaggagtgtctgctacgtccagtttccccagagattcgatggcattgacaggaatgatcgatatgccaacaggaacaccgtgtttttcgatattaacttgagaggtcttgatggcatccaaggaccagtttatgtcggaactggctgtgttttcaaccgaacagctctatatggttatgagcccccaattaagcagaagaagggtggtttcttgtcatcactatgtggcggtaggaagaaggcaagcaaatcaaagaagggctcggacaagaagaagtcgcagaagcatgtggacagttctgtgccagtattcaaccttgaagatatagaggagggagttgaaggcgctggatttgacgacgagaaatcacttcttatgtctcaaatgagcctggagaagagatttggccagtccgcagcgtttgttgcctccactctgatggagtatggtggtgttcctcagtccgcaactccggagtctcttctgaaagaagctatccatgttataagctgtggctatgaggacaagactgaatggggaactgagatcgggtggatctacggttctgtgacagaagacattctcaccggattcaagatgcacgcgcgaggctggcggtcgatctactgcatgcccaagcggccagctttcaaggggtctgcccccatcaatctttcggaccgtctgaaccaggtgctccggtgggctcttgggtccgtggagatcctcttcagccggcactgccccctgtggtacggctacggagggcggctcaagttcctggagagattcgcgtacatcaacaccaccatctacccgctcacgtccatcccgcttctcatctactgcatcctgcccgccatctgtctgctcaccggaaagttcatcattccagagatcagcaacttcgccagcatctggttcatctccctcttcatctcgatcttcgccacgggcatcctggagatgaggtggagcggggtgggcatcgacgagtggtggaggaacgagcagttctgggtgatcgggggcatctccgcgcacctcttcgccgtgttccagggcctgctcaaggtgctggccggcatcgacaccaacttcaccgtcacctccaaggcctcggacgaggacggcgacttcgcggagctgtacatgttcaagtggacgacgctcctgatcccgcccaccaccatcctgatcatcaacctggtcggcgtcgtcgccggcatctcctacgccatcaacagcggataccagtcgtggggcccgctcttcggcaagctcttcttcgccttctgggtcatcgtccacctgtacccgttcctcaagggcctcatgggcaggcagaaccgcaccccgaccatcgtcgtcgtctgggccatcctgctggcgtccatcttctccttgctgtgggttcgcatcgaccccttcaccacccgcgtcactggcccggatacccagacgtgtggcatcaactgctag

SEQ ID NO: 97 - DNA, 3231 bp, Oryza sativa
atggcggcgaacgcggggatggtggcgggatcccgcaaccggaacgagttcgtcatgatccgccccgacggcgacgcgccaccgccggctaagccagggaagagtgtgaatggtcaggtctgccagatttgtggcgacactgttggcgtctcggccaccggcgacgtctttgttgcctgcaatgagtgcgccttcccggtctgccgcccttgctacgagtacgagcgcaaggaagggaaccagtgctgcccccagtgcaagactagatacaagaggcacaaaggtagccctagagttcagggcgatgaggaggaggaagatgttgatgacctggacaatgaattcaattataagcatggcaatggcaaaggtccagagtggcagatacagagacagggggaagatgttgacctgtcttcatcttctcgccacgaacaacatcggattccccgtctgacaagtgggcaacagatctcaggagagatccctgatgcttcccccgatcgccattctatccgcagcggaacatcaagctatgttgatccaagtgttccagttcctgtgaggattgtggacccctccaaggacttgaattcctatgggattaacagtgttgactggcaagaaagagttgccagctggaggaacaagcaggacaaaaatatgatgcaggtagctaataaatatccagaggcaagagggggagacatggaagggactggttcaaatggtgaagatatgcaaatggttgatgatgcacgtctacctctgagccgcatagtgcctatcccttcaaaccagctcaacctttaccggattgttatcattctccgtcttatcatcctgatgttcttcttccaatatcgtgtcactcatccagtgcgggatgcttatggattgtggctagtatctgttatctgtgaaatttggtttgccttatcctggctcctagatcaattcccaaagtggtacccgataaaccgtgaaacataccttgacaggcttgcattgagatatgatagggagggagagccatcacagcttgctcccattgatgtctttgtcagtacggtggatccactaaaggaacctcctctgatcacagcaaacactgttttgtccattctggctgtggattaccctgttgacaaagtgtcatgctatgtttctgacgatggttcagctatgttaacttttgaggctctgtcagaaactgcagaatttgctaggaagtgggttccgttttgcaagaagcacaatattgaaccacgagctccagagttttactttgctcaaaaaatagattacctgaaggacaaaatccaaccttcctttgttaaagaaaggcgggcaatgaagagagagtatgaagaattcaaggtacggatcaatgctcttgttgcgaaggcacaaaaagtacctgaagaggggtggaccatggctgatggcactgcttggcctgggaataacccaagggatcaccctggcatgattcaggtgttcttggggcacagtggtgggcttgacactgatggtaacgagttgccacggcttgtctacgtctctcgtgaaaagaggccaggattccagcatcacaagaaggctggtgcaatgaatgcattgattcgtgtatctgctgtgctgacaaatggtgcctatcttctcaatgtggattgtgatcactacttcaacagtagcaaagctcttagagaagcaatgtgcttcatgatggatcccgcactaggaaggaaaacttgttatgttcagttcccacaaagatttgatggcattgacttgcacgatcgatacgctaatcgcaacatagtcttctttgatattaacatgaaaggtttagatggcattcagggtccagtttatgtgggaacaggttgctgcttcaataggcaggccttgtatggctatgatcctgtactaactgaggctgatttggaacctaacattgttgttaagagctgctgtggtggcagaaagaaaaagagcaagagctacatggatagcaaaaaccgtatgatgaagagaacagagtcttcagctcctatctttaacatggaagatatagaagagggcattgaaggttatgaagatgaaaggtcagtgctgatgtcccagaagagattagagaaacgttttggtcaatcgccaatttttattgcgtccaccttcatgactcaaggaggcataccaccctcaacgaacccagcatctctactgaaggaagccatccatgttatcagttgtggatatgaggacaaaactgaatggggaaaagagattggctggatctatggttcagttactgaggatattctgactggatttaaaatgcacgcaagaggttggatatcaatctattgcatgccaccacggccatgcttcaagggttctgcgccaatcaatctgtctgatcgtcttaaccaagtgctacgttgggctcttgggtctgttgagattctgcttagcagacattgtcctatctggtatggttacaatgggcgtttgaaacttctggagaggctggcttacattaacaccattgtttatccaattacatccattccacttatcgcctattgtgtgcttcctgctatctgtctcctcaccaacaaatttatcattcctgagattagcaattatgctgggatgttctttattctgcttttcgcctccattttcgcaactggtattctggagctccgatggagtggtgttggtatcgaggactggtggagaaatgaacagttctgggtcattggtggcacatctgcccatctcttcgctgtgttccagggtcttctgaaagtgttagcaggaattgataccaacttcactgttacctcaaaggcgtccgatgaggatggtgactttgctgagctatacgtgttcaagtggaccagtctcctcattcccccgaccaccgtgcttgtcatcaacctggtgggcatggtggcgggtatatcatatgccattaacagcggttaccaatcatggggtcctctctttggaaagctcttcttctccatctgggtgatcctccatctctaccccttcctcaagggtctcatgggcaggcagaaccgcactccgaccatcgtcatcgtctggtcgatcctcctcgcgtcgatcttctcccttctgtgggtcaagatcgatcctttcatttcgcctactcagaaagccgtcgccttggggcaatgcggtgtgaactgctga

SEQ ID NO: 98 - DNA, 3246 bp, Oryza sativa
atggacggcgacgcggatgccgtgaagtcggggaggcacgggagcgggcaggcgtgccagatctgcggcgacggcgtgggcacgacggcggagggcgacgtgttcgccgcctgcgacgtctgcggcttcccggtgtgccgcccctgctacgagtacgagcgcaaggatggcacccaggcttgcccccagtgcaagaccaagtacaagcgccacaaggggagcccggcgatccgtggggaggaaggcgaggatactgatgctgatgatgtcagtgactacaactaccctgcatctggcagtgccgaccagaagcagaagattgctgataggatgcgcagttggcgcatgaatgctgggggtggtggagacgtcggccgtcccaagtatgacagtggcgagatcgggctcaccaagtatgacagtggcgagatccctcggggatacatcccttcagtcactaatagccagatctcgggagaaatccctggagcttcccctgatcatcatatgatgtctcctaccggaaacattggcaagcgtgctccattcccctatgtgaaccattcaccaaatccatcaagggagttctctggcagcattggaaatgttgcctggaaagaaagagttgatggctggaaactgaagcaggacaagggagcaattcccatgaccaacgggacaagcattgccccttctgaaggtcggggagttggtgatatcgatgcatccactgattacaatatggaagatgccttactgaatgatgaaactcgccagcctctctctagaaaagttccccttccttcatccagaataaatccctacagaatggtcattgttctgcgtttggttgttctaagcattttccttcactaccgtattacgaatcctgtgcgcaatgcgtatccgctctggcttttatctgttatatgtgagatttggtttgctttgtcctggatattggatcagttcccgaagtggtttccaatcaaccgtgaaacctaccttgataggctggcattgaggtatgacagagaaggtgagccatctcagttggctgctgttgacatttttgtcagtacagtcgaccccatgaaggaacctcctcttgttactgccaataccgtgctgtccattcttgctgttgattacccagtggacaaggtctcttgctatgtatctgacgatggtgctgcaatgctgacttttgatgcattggctgagacttcagagtttgctagaaagtgggttccattcgttaagaagtataacattgagccaagagctcctgagtggtacttctcccagaaaatcgattacttgaaagacaaagtccacccttcatttgttaaagaccgtcgtgccatgaagagagaatatgaagaattcaaagttaggataaatggccttgttgctaaggcacagaaagtcccggaggagggatggatcatgcaagatggcacaccatggccaggaaacaatactagggaccatcctggaatgattcaggttttccttggtcacagtggtggccttgataccgagggtaatgagcttccccgcctggtctacgtatctcgtgagaagcgtcctgggtttcagcaccacaagaaggctggtgccatgaatgctcttgttcgtgtctcagctgtgcttaccaatggacagtacatgttgaatcttgattgtgatcactacatcaacaacagcaaggctctgcgggaagctatgtgcttccttatggatccaaacctaggaaggagtgtctgttatgttcagttcccacaaaggttcgatggtattgataggaatgatcgatatgcgaacaggaacactgtgtttttcgatattaacttgaggggtcttgatggcatccaaggaccagtttatgtgggaactggttgtgtattcaacagaactgctctatatggttatgaacccccaattaagcagaagaagaagggaagtttcttgtcatcactatgtgggggcaggaagaaggcaagcaagtcaaagaagaagagttcggacaagaagaagtcaaacaagcacgtggacagtgctgtgccagttttcaatcttgaagatatagaggagggtgttgaaggtgctggattcgatgatgagaaatcacttcttatgtctcaaatgagcttggagaagagatttggccagtctgcagcgtttgttgcctccactctcatggaatatggtggtgttcctcaatctgcaaccccagaatctcttttgaaagaagctatccatgtgataagttgtggctatgaggacaagaccgaatggggaactgagattgggtggatctacggttccgtgacagaagatattctcactggattcaagatgcatgcgcgaggctggagatcaatctactgcatgcccaagcgcccagctttcaaggggtctgctcctatcaatctttcagatcgtcttaaccaagtgcttcggtgggcacttggttctgttgaaattcttttcagtcgccattgtcccatatggtacggctatggaggacgccttaagttcttggagagatttgcctacatcaacaccactatttatccattgacatcgatcccgcttctcatatactgtgttttgcctgctatctgtttgctcactgggaagttcatcatcccagagattagcaactttgctagtatttggttcatctctctcttcatttcaatttttgccactggtatccttgagatgaggtggagtggtgttggcatcgatgagtggtggaggaatgaacagttctgggttattggaggtatatctgcgcatctttttgccgtcttccagggtctcctcaaggtgcttgctggtatcgacaccaatttcactgtcacctcaaaggcttctgatgaagatggcgactttgctgagctctacatgttcaagtggacaacgcttctcatcccaccgacgaccatcttgatcattaacctggtcggtgttgttgctggtatctcatacgcgatcaacagcggctaccaatcatggggaccgctctttggcaagctcttctttgccttctgggtgattgtccacttgtaccccttcctcaagggtcttatgggtcggcaaaaccgcactccgaccatcgttgttgtttgggcaatccttctggcttcgatcttctcattgctgtgggttcgcatcgatccattcaccacccgtgtcaccggcccagatacccaaacatgtggcatcaactgctaa

SEQ ID NO: 99 - protein, 34 aa, Arabidopsis
  misc_feature (2)..(2): Xaa is Cys, Gly, Met, or Ser
  misc_feature (3)..(3): Xaa is Phe, Val, Leu, or Ile
  misc_feature (5)..(5): Xaa is Lue or Phe
  misc_feature (6)..(6): Xaa is Gln, His or Arg
  misc_feature (9)..(9): Xaa is Thr, Val, Cys, or Ile
  misc_feature (10)..(10): Xaa is Thr, Ser, Met, or Leu
  misc_feature (11)..(11): Xaa is His or Asn
  misc_feature (13)..(13): Xaa is Val or Ala
  misc_feature (14)..(14): Xaa is Lys, Asn, Pro, Arg, Thr, or Glu
  misc_feature (15)..(15): Xaa is Asn or Asp
  misc_feature (17)..(17): Xaa is Tyr or Phe
  misc_feature (18)..(18): Xaa is Pro, Gly, Ala, or Thr
  misc_feature (22)..(22): Xaa is Thr, Val, Ile, or Leu
  misc_feature (28)..(28): Xaa is Ile or Val
  misc_feature (32)..(32): Xaa is Phe, Leu, Ile, Val, or Met
LXXFXXYRXXXPXXXAXXLWLXSVICEXWFAXSW

SEQ ID NO: 100 - protein, 34 aa, Arabidopsis
LCFFLQYRTTHPVKNAYPLWLTSVICEIWFAFSW

SEQ ID NO: 101 - protein, 34 aa, Arabidopsis; identical to SEQ ID NO: 100

SEQ ID NO: 102 - protein, 34 aa, Arabidopsis
  misc_feature (3)..(3): Xaa is Ile, Thr, Val, Met, Ser, or Ala
  misc_feature (7)..(7): Xaa is Phe, Val, or Ile
  misc_feature (10)..(10): Xaa is Ile, Leu, or Phe
  misc_feature (12)..(12): Xaa is Asp, Asn, or Gly
  misc_feature (13)..(13): Xaa is Arg, Lys, Thr, or Gln
  misc_feature (16)..(16): Xaa is Ile, Val, or Thr
  misc_feature (18)..(18): Xaa is Glu, Ala, Gln, or Lys
  misc_feature (19)..(19): Xaa is Ile or Leu
  misc_feature (20)..(20): Xaa is  Ser, Asn, or Thr
  misc_feature (22)..(22): Xaa is Tyr, Phe, Leu, Ile, or Ala
  misc_feature (23)..(23): Xaa is Ala or Glu
  misc_feature (24)..(24): Xaa is Ser or Gly
  misc_feature (25)..(25): Xaa is Ile, Met, Leu, Ala, or Val
  VARIANT (26)..(26): Xaa is Trp, Cys, Phe, Leu, Val, or Ile
  VARIANT (28)..(28): Xaa is Ile, Met, Leu, or Val
  misc_feature (29)..(29): Xaa is  is Leu or Ser
  misc_feature (30)..(30): Xaa is Leu, Ser or Ala
  misc_feature (32)..(32): Xaa is Ile, Val, Ala, Leu, Ser, Met or Gly
  misc_feature (33)..(33): Xaa is Ser or Cys
YCXLPAXCLXTXXFIXPXXXNXXXXXFXXXFXXI

SEQ ID NO: 103 - protein, 34 aa, Arabidopsis
YCILPAFCLITDRFIIPEISNYASIWFILLFISI

SEQ ID NO: 104 - protein, 34 aa, Arabidopsis; identical to SEQ ID NO: 103

SEQ ID NO: 105 - protein, 32 aa, Arabidopsis
  misc_feature (5)..(5): Xaa is Thr, Val, Ile, or Ala
  misc_feature (7)..(7): Xaa is Ala or Ser
  misc_feature (9)..(9): Xaa is Leu or Phe
  misc_feature (10)..(10): Xaa is Phe or Leu
  misc_feature (12)..(12): Xaa is Val or Leu
  misc_feature (13)..(13): Xaa is Phe or Val
  misc_feature (14)..(14): Xaa is Gln or Leu
  misc_feature (16)..(16): Xaa is Leu, Ile, or Met
  VARIANT (17)..(17): Xaa is Leu or Phe
  misc_feature (20)..(20): Xaa is Leu, Phe or Ile
  misc_feature (23)..(23): Xaa is Ile or Val
  misc_feature (24)..(24): Xaa is Asp, Asn, Ser, Glu, or Lys
  misc_feature (26)..(26): Xaa is Asn or Ser
  misc_feature (28)..(28): Xaa is Thr or Ile
  misc_feature (30)..(30): Xaa is Thr or Ala
VIGGXSXHXXAXXXGXXKVXAGXXTXFXVXSK

SEQ ID NO: 106 - protein, 33 aa, Arabidopsis
VIGGTSAHLFAVFQGLLKVLAGIDTNFTVTSKA

SEQ ID NO: 107 - protein, 33 aa, Arabidopsis; identical to SEQ ID NO: 106

SEQ ID NO: 108 - protein, 35 aa, Arabidopsis
  misc_feature (2)..(2): Xaa is Val or Ile
  misc_feature (3)..(3): Xaa is Asn or Ser
  misc_feature (4)..(4): Xaa is Ser or Asn
  misc_feature (6)..(6): Xaa is Tyr or Phe
  misc_feature (7)..(7): Xaa is Ser, Asp or Glu
  misc_feature (13)..(13): Xaa is Phe, Met, or Leu
  misc_feature (15)..(15): Xaa is Lys or Arg
  misc_feature (17)..(17): Xaa is Phe or Leu
  misc_feature (19)..(19): Xaa is Ala or Ser
  misc_feature (20)..(20): Xaa is Leu, Ile, or Phe
  misc_feature (23)..(23): Xaa is Ile or Val
  misc_feature (24)..(24): Xaa is Ala, Val, Ile, or Leu
  misc_feature (33)..(33): Xaa is Leu, Met, or Val
  misc_feature (34)..(34): Xaa is Leu, Met, Val, or Ile
AXXXGXXSWGPLXGXLXFXXWVXXHLYPFLKGXXG

SEQ ID NO: 109 - protein, 35 aa, Arabidopsis
AVNSGYQSWGPLFGKLFFALWVIAHLYPFLKGLLG

SEQ ID NO: 110 - protein, 35 aa, Arabidopsis; identical to SEQ ID NO: 109

SEQ ID NO: 111 - protein, 14 aa, Arabidopsis
  misc_feature (1)..(1): Xaa is Gly or Ala
  misc_feature (2)..(2): Xaa is Ile, Met or Val
  misc_feature (3)..(3): Xaa is Val or Ile
  misc_feature (4)..(4): Xaa is Ala, Ser, or Val
  misc_feature (6)..(6): Xaa is Val, Ile, or Phe
  misc_feature (8)..(8): Xaa is Tyr, Thr, Asp, or Asn
  misc_feature (10)..(10): Xaa is Val or Ile
  misc_feature (11)..(11): Xaa is Asn or Ser
  misc_feature (12)..(12): Xaa is Ser or Asn
  misc_feature (14)..(14): Xaa is Tyr or Phe
XXXXGXSXAXXXGX

SEQ ID NO: 112 - protein, 14 aa, Arabidopsis
GVVAGVSYAINSGY

SEQ ID NO: 113 - protein, 14 aa, Arabidopsis
GVVAGVSYAINSGY

SEQ ID NO: 114 - protein, 22 aa, Arabodopsis
  misc_feature (1)..(1): Xaa is Val or Ile
  misc_feature (2)..(2): Xaa is Ile, Val, or Leu
  misc_feature (5)..(5): Xaa is Ser or Ala
  misc_feature (6)..(6): Xaa is Val, Ile or Ala
  misc_feature (8)..(8): Xaa is Leu or Ile
  misc_feature (9)..(9): Xaa is Ala or Ser
  misc_feature (11)..(11): Xaa is Ile or Phe
  misc_feature (12)..(12): Xaa is Phe or Leu
  misc_feature (13)..(13): Xaa is Ser or Thr
  misc_feature (14)..(14): Xaa is Leu or Val
  misc_feature (15)..(15): Xaa is Leu or Met
  misc_feature (18)..(18): Xaa is Arg or Lys
  misc_feature (19)..(19): Xaa is Ile or Val
  misc_feature (20)..(20): Xaa is Asp or Asn
XXVWXXLXXSXXXXXWVXXXPF

SEQ ID NO: 115 - protein, 22 aa, Arabidopsis
VVVWSVLLASIFSLLWVRIDPF

SEQ ID NO: 116 - protein, 22 aa, Arabidopsis
VVVWSVLLASIFSLLWVRIDPF

SEQ ID NO: 117 - protein, 18 aa, Arabidopsis
  misc_feature (3)..(3): Xaa is Leu or Phe
  misc_feature (4)..(4): Xaa is Leu, Phe or Met
  misc_feature (6)..(6): Xaa is Arg, Lys, or Asn
  misc_feature (10)..(10): Xaa is Ile or Leu
  misc_feature (15)..(15): Xaa is His, Thr, Asn, Ser, or Gly
  misc_feature (16)..(16): Xaa is Gly or Cys
  misc_feature (17)..(17): Xaa is Arg, Lys, or Gly
EIXXSXHCPXWYGYXXXL

SEQ ID NO: 118 - protein, 18 aa, Arabidopsis
EILFSRHCPIWYGYNGRL

SEQ ID NO: 119 - protein, 18 aa, Arabidopsis
EILFSRHCPIWYGYNGRL

SEQ ID NO: 120 - protein, 14 aa, Arabidopsis
  misc_feature (1)..(1): Xaa is Phe or Leu
  misc_feature (5)..(5): Xaa is Ala, Ser, Thr
  misc_feature (9)..(9): Xaa is Pro or Thr
  misc_feature (11)..(11): Xaa is Thr, Met or Leu
  misc_feature (13)..(13): Xaa is Val, Ile or Leu
XKWTXLLIXPXTXL

SEQ ID NO: 121 - protein, 14 aa, Arabidopsis
FKWTALLIPPTTVL

SEQ ID NO: 122 - protein, 14 aa, Arabidopsis
FKWTALLIPPTTVL

SEQ ID NO: 123 - protein, 14 aa, Arabidopsis
  VARIANT (1)..(1): / replace = "Gly"
  VARIANT (2)..(2): / replace = "Met" or "Val"
  VARIANT (3)..(3): / replace = "Ile"
  VARIANT (4)..(4): / replace = "Ser" or "Val"
  VARIANT (6)..(6): / replace = "Ile" or "Phe"
  VARIANT (8)..(8): / replace = "Asn", "Asp", or "Thr"
  VARIANT (10)..(10): / replace = "Ile"
  VARIANT (11)..(11): / replace = "Ser"
  VARIANT (12)..(12): / replace = "Asn"
GIVAGVSYAVNSGY

SEQ ID NO: 124 - protein, 22 aa, Arabidopsis
  VARIANT (2)..(2): / replace =  "Val" or "Leu"
  VARIANT (5)..(5): / replace = "Ala"
  VARIANT (6)..(6): / replace = "Ile" or "Ala"
  VARIANT (8)..(8): / replace = "Ile"
  VARIANT (9)..(9): / replace = "Ser"
  VARIANT (11)..(11): / replace = "Phe"
  VARIANT (12)..(12): / replace = "Leu"
  VARIANT (13)..(13): / replace = "Thr"
  VARIANT (14)..(14): / replace = "Val"
  VARIANT (15)..(15): / replace = "Met"
  VARIANT (18)..(18): / replace = "Lys"
  VARIANT (19)..(19): / replace = "Val"
  VARIANT (20)..(20): / replace = "Asp"
VIVWSVLIASIFSLLWVRINPF

SEQ ID NO: 125 - protein, 18 aa, Arabidopsis
  VARIANT (3)..(3): / replace = "Phe"
  VARIANT (4)..(4): / replace = "Phe" or "Met"
  VARIANT (6)..(6): / replace = "Lys" or "Asn"
  VARIANT (11)..(11): / replace = "Leu"
  VARIANT (15)..(15): / replace = "Gly", "Ser", "Asn", or "Thr"
  VARIANT (16)..(16): / replace = "Cys"
  VARIANT (17)..(17): / replace = "Gly" or " Lys"
EILLSPHCPIWYGYHGRL

SEQ ID NO: 126 - protein, 34 aa, Arabidopsis
LGFFLQYRTTHPVKDAYPLWLTSVICEIWFAFSW

SEQ ID NO: 127 - protein, 34 aa, Arabidopsis
LGFFLQYRVTHPVKDAYPLWLTSVICEIWFALSW

SEQ ID NO: 128 - protein, 34 aa, Arabidopsis
LGFFLQYRCSHPVNDAYPLWLVSVICEVWFALSW

SEQ ID NO: 129 - protein, 34 aa, Arabidopsis
LGVFLHYRTTHPVKDAYALWLTSVICEIWFAFSW

SEQ ID NO: 130 - protein, 34 aa, Arabidopsis
LCFFFQYRISHPVRNAYGLWLVSVICEVWFALSW

SEQ ID NO: 131 - protein, 34 aa, Arabidopsis
LCFFFQYRVSHPVRNAYGLWLVSVICEVWFALSW

SEQ ID NO: 132 - protein, 34 aa, Arabidopsis
LMFFFQYRVTHPVRDAYGLWLVSVICEIWFALSW

SEQ ID NO: 133 - protein, 34 aa, Arabidopsis
LCFFFQYRITHPVEDAYGLWLVSVICEVWFALSW

SEQ ID NO: 134 - protein, 34 aa, Arabidopsis
LCLFLHYRITNPVPNAFALWLVSVICEIWFALSW

SEQ ID NO: 135 - protein, 34 aa, Arabidopsis
LCLFLHYRITNPVPNAFTLWLISVICEIWFAFSW

SEQ ID NO: 136 - protein, 34 aa, Arabidopsis
LCIFLHYRITNPVPNAYALWLISVICEIWFAISW

SEQ ID NO: 137 - protein, 34 aa, Arabidopsis
LCIFLHYRITNPVPNAYPLWLVSVICEIWFAISW

SEQ ID NO: 138 - protein, 34 aa, Arabidopsis
LCIFLHYRITNPVTNAYPLWLLSVICEIWFAISW

SEQ ID NO: 139 - protein, 34 aa, Arabidopsis
LSIFLHYRITNPVRNAYPLWLLSVICEIWFALSW

SEQ ID NO: 140 - protein, 34 aa, Arabidopsis
LCIFLRYRITHPVNNAYPLWLLSVICEIWFALSW

SEQ ID NO: 141 - protein, 34 aa, Arabidopsis
LCIFLHYRITNPVRNAYPLWLLSVICEIWFALSW

SEQ ID NO: 142 - protein, 34 aa, Arabidopsis
LGLFFHYRILHPVNDAYGLWLTSVICEIWFAVSW

SEQ ID NO: 143 - protein, 34 aa, Arabidopsis
LGLFFHYRILHPVNDAFGLWLTSVICEIWFAVSW

SEQ ID NO: 144 - protein, 34 aa, Arabidopsis
LGLFFHYRILHPVNDAYALWLISVICEIWFAVSW

SEQ ID NO: 145 - protein, 34 aa, Arabidopsis
LGLFFHYRILHPVKDAYALWLISVICEIWFAVSW

SEQ ID NO: 146 - protein, 34 aa, Arabidopsis
LSLFFHYRILHPVKDAYALWLTSVICEIWFAVSW

SEQ ID NO: 147 - protein, 34 aa, Arabidopsis; identical to SEQ ID NO: 145

SEQ ID NO: 148 - protein, 34 aa, Arabidopsis; identical to SEQ ID NO: 142

SEQ ID NO: 149 - protein, 34 aa, Arabidopsis
LCLFFHYRILHPVNDAYALWLTSVICEIWFAVSW

SEQ ID NO: 150 - protein, 34 aa, Arabidopsis
LGLFFHYRILHPVNDAYALWLTSVICEIWFAVSW

SEQ ID NO: 151 - protein, 34 aa, Arabidopsis
LGFFFHYRVMHPVNDAFALWLISVICEIWFAMSW

SEQ ID NO: 152 - protein, 34 aa, Arabidopsis
LCFFFHYRVMHPVPDAFALWLISVICEIWFAMSW

SEQ ID NO: 153 - protein, 34 aa, Arabidopsis
LGFFFHYRVMHPVPDAFALWLISVICEIWFAMSW

SEQ ID NO: 154 - protein, 34 aa, Arabidopsis
LGFFFHYRVMHPAKDAFALWLISVICEIWFAMSW

SEQ ID NO: 155 - protein, 34 aa, Arabidopsis; identical to SEQ ID NO: 151

SEQ ID NO: 156 - protein, 34 aa, Arabidopsis; identical to SEQ ID NO: 153

SEQ ID NO: 157 - protein, 34 aa, Arabidopsis; identical to SEQ ID NO: 144

SEQ ID NO: 158 - protein, 34 aa, Arabidopsis
YCILPAFCLITDKFIIPEISNYASIWFILLFISI

SEQ ID NO: 159 - protein, 34 aa, Arabidopsis
YCTLPAFCLLTNKFIIPEISNFASMWFILLFVSI

SEQ ID NO: 160 - protein, 34 aa, Arabidopsis
YCVLPAVCLLTGKFIIPEISNYASMWFILLFISI

SEQ ID NO: 161 - protein, 34 aa, Arabidopsis
YCMLPAFCLITNTFIIPEISNLASLCFMLLFASI

SEQ ID NO: 162 - protein, 34 aa, Arabidopsis
YCVLPAICLLTNKFIIPEISNYAGMFFILLFASI

SEQ ID NO: 163 - protein, 34 aa, Arabidopsis
YCVLPAICLLTNKFIIPAISNYAGAFFILLFASI

SEQ ID NO: 164 - protein, 34 aa, Arabidopsis
YCTLPAVCLFTNQFIIPQISNIASIWFLSLFLSI

SEQ ID NO: 165 - protein, 34 aa, Arabidopsis
YCTLPAVCLLTNKFIIPQISNIASIWFISLFLSI

SEQ ID NO: 166 - protein, 34 aa, Arabidopsis
YCILPAVCLLTNKFIIPQISNIASIWFISLFLSI

SEQ ID NO: 167 - protein, 34 aa, Arabidopsis
YCTLPAVCLLTGKFIIPQISNLASLWFISLFLSI

SEQ ID NO: 168 - protein, 34 aa, Arabidopsis
YCILPAICLLTGKFIIPEISNFASIWFISLFISI

SEQ ID NO: 169 - protein, 34 aa, Arabidopsis
YCVLPAICLLTGKFIIPEISNFASIWFISLFISI

SEQ ID NO: 170 - protein, 34 aa, Arabidopsis
YCILPAVCLLTGKFIIPKISNLESVWFISLFISI

SEQ ID NO: 171 - protein, 34 aa, Arabidopsis
YCILPAICLLTGKFIIPEISNFASIWFISLFLSI

SEQ ID NO: 172 - protein, 34 aa, Arabidopsis
YCSLPAVCLLTGKFIVPEISNYAGILFMLMFISI

SEQ ID NO: 173 - protein, 34 aa, Arabidopsis
YCSLPAICLLTGKFIVPEISNYAGILFLLMFMSI

SEQ ID NO: 174 - protein, 34 aa, Arabidopsis
YCSLPAICLLTGKFIVPEISNYASILFMALFGSI

SEQ ID NO: 175 - protein, 34 aa, Arabidopsis
YCSLPAICLLTGKFIVPEISNYASILFMALFSSI

SEQ ID NO: 176 - protein, 34 aa, Arabidopsis
YCTLPAICLLTGKFIVPEISNYASIVFMALFISI

SEQ ID NO: 177 - protein, 34 aa, Arabidopsis
YCTLPAICLLTGKFIVPEISNYASLVFMALFISI

SEQ ID NO: 178 - protein, 34 aa, Arabidopsis
YCALPAVCLLTGKFIVPEISNYASIIFMALFISI

SEQ ID NO: 179 - protein, 34 aa, Arabidopsis
YCTLPAICLLTGKFITPELNNVASLWFMSLFICI

SEQ ID NO: 180 - protein, 34 aa, Arabidopsis
YCTLPAICLLTGKFITPELTNIASLWFMSLFICI

SEQ ID NO: 181 - protein, 34 aa, Arabidopsis
YCTLPAICLLTGKFITPELTNVASLWFMSLFICI

SEQ ID NO: 182 - protein, 34 aa, Arabidopsis
YCTLPAICLLTGKFITPELTNVASIWFMALFICI

SEQ ID NO: 183 - protein, 34 aa, Arabidopsis; identical to SEQ ID NO: 181

SEQ ID NO: 184 - protein, 34 aa, Arabidopsis
YCTLPAICLLTGKFIIPELSNAAGMWFVSLFFCI

SEQ ID NO: 185 - protein, 27 aa, Arabidopsis
YCTLPAVCLLTGKFIIPQISNLASLWF

SEQ ID NO: 186 - protein, 34 aa, Arabidopsis
YCTLPAVCLLTGKFIVPEISNYASILFMLMFLSI

SEQ ID NO: 187 - protein, 32 aa, Arabidopsis
VIGGTSAHLFAVFQGLLKVFAGIDTNFTVTSK

SEQ ID NO: 188 - protein, 32 aa, Arabidopsis
VIGGVSAHLFAVFQGILKVLAGIDTNFTVTSK

SEQ ID NO: 189 - protein, 32 aa, Arabidopsis
VIGGVSAHLFAVFQGLLKVLAGIDTNFTVTSK

SEQ ID NO: 190 - protein, 32 aa, Arabidopsis
VIGGISAHLFAVFQGLLKVLAGIDTNFTVTSK

SEQ ID NO: 191 - protein, 32 aa, Arabidopsis
VIGGISAHLFAVFQGLLKVLAGIDTSFTVTSK

SEQ ID NO: 192 - protein, 32 aa, Arabidopsis
VIGGASSHLFALFQGLLKVLAGVNTNFTVTSK

SEQ ID NO: 193 - protein, 32 aa, Arabidopsis
VIGGVSSHLFALFQGLLKVLAGVSTNFTVTSK

SEQ ID NO: 194 - protein, 32 aa, Arabidopsis
VIGGVSAHLFALFQGLLKVLAGVETNFTVTSK

SEQ ID NO: 195 - protein, 32 aa, Arabidopsis
VIGGVSAHLFALFQGLLKVLAGVDTNFTVTSK

SEQ ID NO: 196 - protein, 32 aa, Arabidopsis
VIGGVSSHLFALFQGLLKVLAGVNTNFTVTSK

SEQ ID NO: 197 - protein, 32 aa, Arabidopsis; identical to SEQ ID NO: 192

SEQ ID NO: 198 - protein, 32 aa, Arabidopsis
VIGGVSSHLFAVFQGLLKVIAGVDTSFTVTSK

SEQ ID NO: 199 - protein, 32 aa, Arabidopsis
VIGGVSSHLFAVFQGLLKVIAGIDTSFTVTSK

SEQ ID NO: 200 - protein, 32 aa, Arabidopsis
VIGGVSSHVFALFQGLLKVIAGIDTSFTVTSK

SEQ ID NO: 201 - protein, 32 aa, Arabidopsis
VIGGVSAHLFAVFQGLLKVFAGIDTSFTVTSK

SEQ ID NO: 202 - protein, 32 aa, Arabidopsis
VIGGVSSHLFAVFQGLLKVFAGVDTSFTVTSK

SEQ ID NO: 203 - protein, 32 aa, Arabidopsis
VIGGVSSHLFALFQGLLKVIAGIDTSFTVTSK

SEQ ID NO: 204 - protein, 32 aa, Arabidopsis
VIGGVSAHFLAVFLGMFKVLAGVKTNFIVTSK

SEQ ID NO: 205 - protein, 32 aa, Arabidopsis
VIGGVSAHLFALVQGLLKVLAGVNTNFTVTSK

SEQ ID NO: 206 - protein, 35 aa, Arabidopsis
AINSGYQSWGPLFGKLFFALWVIAHLYPFLKGLLG

SEQ ID NO: 207 - protein, 35 aa, Arabidopsis
AVNSGYQSWGPLFGKLFFALWVIAHLYPFLKGLMG

SEQ ID NO: 208 - protein, 35 aa, Arabidopsis
AINSGYQSWGPLFGKLFFAIWVIAHLYPFLKGLLG

SEQ ID NO: 209 - protein, 35 aa, Arabidopsis
AINSGYQSWGPLFGKLFFAIWVIVHLYPFLKGLLG

SEQ ID NO: 210 - protein, 35 aa, Arabidopsis
AINSGYQSWGPLMGKLLFAFWVVAHLYPFLKGLLG

SEQ ID NO: 211 - protein, 35 aa, Arabidopsis
AINSGYQSWGPLFGKLFFSIWVILHLYPFLKGLLM

SEQ ID NO: 212 - protein, 35 aa, Arabidopsis
AINSGYQSWGPLFGKLFFAIWVILHLYPFLKGLMG

SEQ ID NO: 213 - protein, 35 aa, Arabidopsis
AINSGYQSWGPLFGKLFFAFWVIVHLYPFLKGLMG

SEQ ID NO: 214 - protein, 35 aa, Arabidopsis
AINSGYQSWGPLFGKLFFAFWVIIHLYPFLKGLMG

SEQ ID NO: 215 - protein, 35 aa, Arabidopsis; identical to SEQ ID NO: 213

SEQ ID NO: 216 - protein, 35 aa, Arabidopsis
AISNGYDSWGPLFGRLFFALWVIVHLYPFLKGMLG

SEQ ID NO: 217 - protein, 35 aa, Arabidopsis
AINNGYDSWGPLFGRLFFALWVIVHLYPFLKGLLG

SEQ ID NO: 218 - protein, 35 aa, Arabidopsis
AISNGYDSWGPLFGRLFFAFWVILHLYPFLKGLLG

SEQ ID NO: 219 - protein, 35 aa, Arabidopsis
AISNGYDSWGPLFGRLFFALWVIIHLYPFLKGLLG

SEQ ID NO: 220 - protein, 35 aa, Arabidopsis
AISNGYDSWGPLFGRLFFALWVVIHLYPFLKGLLG

SEQ ID NO: 221 - protein, 35 aa, Arabidopsis
AINNGYDSWGPLFGRLFFALWVILHLYPFLKGLLG

SEQ ID NO: 222 - protein, 35 aa, Arabidopsis
AINNGYDSWGPLFGRLFFALWVIVHLYPFLKGVMG

SEQ ID NO: 223 - protein, 35 aa, Arabidopsis
AINNGYDSWGPLFGKLFFALWVIVHLYPFLKGVMG

SEQ ID NO: 224 - protein, 35 aa, Arabidopsis
AINNGYESWGPLFGKLFFAFWVIVHLYPFLKGLVG

SEQ ID NO: 225 - protein, 35 aa, Arabidopsis
AINNGFESWGPLLGKLLFSLWVILHLYPFLKGMIG

SEQ ID NO: 226 - protein, 14 aa, Arabidopsis
GIVAGVSYAINSGY

SEQ ID NO: 227 - protein, 14 aa, Arabidopsis
GIVSGVSTAINSGY

SEQ ID NO: 228 - protein, 14 aa, Arabidopsis
GMVAGISYAINSGY

SEQ ID NO: 229 - protein, 14 aa, Arabidopsis
GVVAGVSYAINSGY

SEQ ID NO: 230 - protein, 14 aa, Arabidopsis
GVVAGFSYAINSGY

SEQ ID NO: 231 - protein, 14 aa, Arabidopsis
GVVAGISYAINSGY

SEQ ID NO: 232 - protein, 14 aa, Arabidopsis
GVIVGVSDAISNGY

SEQ ID NO: 233 - protein, 14 aa, Arabidopsis
GVIVGVSDAISNGY

SEQ ID NO: 234 - protein, 14 aa, Arabidopsis
GVIVGISDAISNGY

SEQ ID NO: 235 - protein, 14 aa, Arabidopsis
GIVVGISDAISNGY

SEQ ID NO: 236 - protein, 14 aa, Arabidopsis
GVVVGVSDAINNGY

SEQ ID NO: 237 - protein, 14 aa, Arabidopsis
GVVVGISDAINNGY

SEQ ID NO: 238 - protein, 14 aa, Arabidopsis
GVIVGVSDAINNGY

SEQ ID NO: 239 - protein, 14 aa, Arabidopsis
GVVAGVSNAINNGY

SEQ ID NO: 240 - protein, 14 aa, Arabidopsis
GVVAGISNAINNGY

SEQ ID NO: 241 - protein, 14 aa, Arabidopsis
GVVAGVSNAINNGY

SEQ ID NO: 242 - protein, 14 aa, Arabidopsis
AVVAGVSYAINNGF

SEQ ID NO: 243 - protein, 22 aa, Arabidopsis
VIVWSVLLASIFSLLWVRIDPF

SEQ ID NO: 244 - protein, 22 aa, Arabidopsis
VIVWSILLASIFSLLWVRIDPF

SEQ ID NO: 245 - protein, 22 aa, Arabidopsis
VIVWSALLASIFSLLWVRINPF

SEQ ID NO: 246 - protein, 22 aa, Arabidopsis
VIVWSILLASIFSLLWVKIDPF

SEQ ID NO: 247 - protein, 22 aa, Arabidopsis
VIVWSVLLASIFSLLWVKIDPF

SEQ ID NO: 248 - protein, 22 aa, Arabidopsis
VVVWSVLLASIFSLLWVRIDPF

SEQ ID NO: 249 - protein, 22 aa, Arabidopsis
VVVWSILLASIFSLLWVRIDPF

SEQ ID NO: 250 - protein, 22 aa, Arabidopsis
VVVWSVLLASIFSLLWVRIDPF

SEQ ID NO: 251 - protein, 22 aa, Arabidopsis
VVVWAILLASIFSLLWVRIDPF

SEQ ID NO: 252 - protein, 22 aa, Arabidopsis
VVVWAILLASIFSLMWVRIDPF

SEQ ID NO: 253 - protein, 22 aa, Arabidopsis
ILVWSILLASILTLLWVRVNPF

SEQ ID NO: 254 - protein, 22 aa, Arabidopsis
IIVWSILIASILTLLWVRVNPF

SEQ ID NO: 255 - protein, 22 aa, Arabidopsis
ILVWSILLASILTLMWVRINPF

SEQ ID NO: 256 - protein, 22 aa, Arabidopsis
ILVWAILLSSILTLLWVRINPF

SEQ ID NO: 257 - protein, 22 aa, Arabidopsis
ILVWAILLSSILTLLWVRINPF

SEQ ID NO: 258 - protein, 22 aa, Arabidopsis
ILVWAILLASIFSLLWVRINPF

SEQ ID NO: 259 - protein, 22 aa, Arabidopsis
VIVWSILLASIFSLLWVRVDPF

SEQ ID NO: 260 - protein, 22 aa, Arabidopsis
VLVWAILLASFFSSVWVKIDPF

SEQ ID NO: 261 - protein, 18 aa, Arabidopsis
EILLSRHCPIWYGYTGRL

SEQ ID NO: 262 - protein, 18 aa, Arabidopsis
EIFLSRHCPLWYGYNGKL

SEQ ID NO: 263 - protein, 18 aa, Arabidopsis
EILLSRHCPIWYGYNGRL

SEQ ID NO: 264 - protein, 18 aa, Arabidopsis
EILFSRHCPIWYGYNGRL

SEQ ID NO: 265 - protein, 18 aa, Arabidopsis
EILFSRHCPIWYGYSGRL

SEQ ID NO: 266 - protein, 18 aa, Arabidopsis
EILFSRHCPIWYGYGGRL

SEQ ID NO: 267 - protein, 18 aa, Arabidopsis
EILFSRHCPLWYGYGGRL

SEQ ID NO: 268 - protein, 18 aa, Arabidopsis
EIFLSRHCPIWYGYGGGL

SEQ ID NO: 269 - protein, 18 aa, Arabidopsis
EIFFSRHCPIWYGYGGGL

SEQ ID NO: 270 - protein, 18 aa, Arabidopsis
EILLSKHCPIWYGYGCGL

SEQ ID NO: 271 - protein, 18 aa, Arabidopsis
EIFFSNHCPLWYGYGGGL

SEQ ID NO: 272 - protein, 18 aa, Arabidopsis
EIFFSKHCPLWYGYGGGL

SEQ ID NO: 273 - protein, 18 aa, Arabidopsis
EIFMSKHCPLWYGYGGGL

SEQ ID NO: 274 - protein, 18 aa, Arabidopsis
EILLSRHCPIWYGYGCGL

SEQ ID NO: 275 - protein, 14 aa, Arabidopsis
FKWTSLLIPPTTVL

SEQ ID NO: 276 - protein, 14 aa, Arabidopsis
FKWTSLLIPPTTIL

SEQ ID NO: 277 - protein, 14 aa, Arabidopsis
FKWTTLLIPPTTLL

SEQ ID NO: 278 - protein, 14 aa, Arabidopsis
FKWTTLLIPPTTLL

SEQ ID NO: 279 - protein, 14 aa, Arabidopsis
FKWTTLLIPPTTIL

SEQ ID NO: 280 - protein, 14 aa, Arabidopsis
FKWTSLLIPPTTLL

SEQ ID NO: 281 - protein, 14 aa, Arabidopsis
FKWTSLLIPPMTLL

SEQ ID NO: 282 - protein, 14 aa, Arabidopsis
FKWTSLLIPPLTLL

SEQ ID NO: 283 - protein, 14 aa, Arabidopsis
LKWTTLLIIPTTLL

SEQ ID NO: 284 - protein, 14 aa, Arabidopsis
FKWTTLLIPPTTVL

SEQ ID NO: 285 - protein, 18 aa, Arabidopsis
EILLSRHCPIWYGYNGKL

The invention claimed is:

1. A method for controlling weeds at a locus for growth of a plant, the method comprising: (a) applying an herbicide composition comprising CESA-inhibiting herbicides to the locus; and (b) planting a seed at the locus, wherein the seed produces a plant that comprises in at least some of its cells a polynucleotide encoding a mutated cellulose synthase (CESA) polypeptide having at least 80% sequence identity to SEQ ID NO: 1, wherein the polynucleotide is operably linked to a promoter operable in plant cells, wherein the expression of said polynucleotide confers to the plant tolerance to CESA-inhibiting herbicides, and wherein the mutated CESA polypeptide comprises one or more of the following motifs:

i) Motif 1a:

(SEQ ID NO: 99)
L[C/G/M/S][F/V/L/I]F [L/F][Q/H/R]YR[T/V/C/I]

[T/S/M/L][H/N]P[V/A][K/N/P/R/T/E][N/D]A[Y/F]

[P/G/A/T]LWL[I/V/I/L]SVICE[I/V]WFA[F/L/I/V/M]SW wherein the amino acid at position 8 and/or 23 within said motif of the corresponding wildtype sequence is substituted by any other amino acid, ii) Motif 2a:

(SEQ ID NO: 102)
YC[I/T/V/M/S/A]LPA[F/V/I]CL[I/L/F]T[D/N/G]

[R/K/T/Q]FI[I/V/T]P[E/A/Q/K][I/L][S/N/T]N

[Y/F/L/I/A][A/E][S/G][I/M/L/A/V][W/C/F/L/V/I]F

[I/M/L/V][L/S][L/S/A]F[I/V/A/L/S/M/G][S/C]I wherein the amino acid at position 4, 17, and/or 24 within said motif of the corresponding wildtype sequence is substituted by any other amino acid, iii) Motif 3a:

(SEQ ID NO: 105)
VIGG[T/V/I/A]S[A/S]H[L/F][F/L]A[V/L][F/V][Q/L]G

[L/I/M][L/F]KV[L/FMAG[I/V][D/N/S/E/K]T[N/S]F[T/I]

V[T/A]SK wherein the amino acid at position 1, 3, 18, and/or 28 within said motif of the corresponding wildtype sequence is substituted by any other amino acid, iv) Motif 4a:

(SEQ ID NO: 108)
A[V/I][N/S][S/N]G[Y/F][Q/D/E]SWGPL[F/M/L]G[K/R]L

[F/L]F[A/SI[L/I/F]WV[I/V][A/V/I/L]HLYPFLKG

[L/M/V][L/M/V(I]G wherein the amino acid at position 9, 12, 13, 15, 19, and/or 24 within said motif of the corresponding wildtype sequence is substituted by any other amino acid, v) Motif 5a:

(SEQ ID NO: 111)
[G/A][I/M/V][V/I][A/S/V]G[V/I/F]S[Y/T/D/N]A[V/I]

[N/S][S/N]G[Y/F]

wherein the amino acid at position 8 within said motif of the corresponding wildtype sequence is substituted by any other amino acid, vi) Motif 6a:

(SEQ ID NO: 114)
[V/I][I/V/L]VW[S/A][V/I/A]L[L/I][A/S]S[I/F][F/L]

[S/T][L/V][L/M]WV[R/K][I/V][N/D]PF wherein the amino acid at position 9, 11, 12, and/or 14 within said motif of the corresponding wildtype sequence is substituted by any other amino acid, vii) Motif 7a:

(SEQ ID NO: 117)
EI[L/F][L/F/M]S[R/K/N]HCP[I/L]WYGY[H/T/N/S/G]

[G/C][R/K/G]L wherein the amino acid at position 5, 13, 15, and/or 16 within said motif of the corresponding wildtype sequence is substituted by any other amino acid, and viii) Motif 8a:

(SEQ ID NO: 120)
[F/L]KWT[A/S/T]LLI[P/T]P[T/M/L]T[V/I/L]L wherein the amino acid at position 10 within said motif of the corresponding wildtype sequence is substituted by any other amino acid, wherein the mutated CESA polypeptide has an amino acid sequence that differs from the wildtype amino acid sequence at one or more positions corresponding to positions 307, 872, 885, 892, 928, 930, 945, 1008, 1011, 1012, 1014, 1018, 1023, 999, 1051, 1053, 1054, 1056, 832, 840, 842, 843, 982 of SEQ ID NO: 1.

2. The method of claim 1, wherein herbicide composition is applied to the weeds and to the plant produced by the seed.

3. The method of claim 1, wherein the CESA-inhibiting herbicide comprises a compound having the Formula (I):

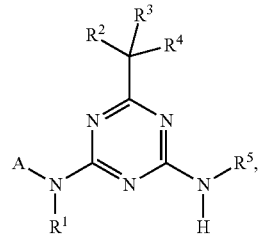

wherein
A is phenyl, which is substituted by two to five substituents selected from the group consisting of halogen, CN, $NO_2$, $C_1$-$C_6$-alkyl, $C_1$-$C_6$-haloalkyl, $C_2$-$C_6$-alkenyl, $C_2$-$C_6$-haloalkenyl, $C_2$-$C_6$-alkynyl, $C_1$-$C_6$-haloalkynyl, OH, $C_1$-$C_6$-alkoxy, $C_6$-alkyl)sulfinyl, ($C_1$-$C_6$-alkyl)sulfonyl, amino, ($C_1$-$C_6$-alkyl)amino, di($C_1$-$C_6$-alkyl)amino, ($C_1$-$C_6$-alkyl)carbonyl, ($C_1$-$C_6$-alkoxy)carbonyl;

$R^1$ H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl, ($C_1$-$C_6$-alkoxy)carbonyl, ($C_1$-$C_6$-alkyl)sulfonyl or phenylsulfonyl, wherein the phenyl is unsubstituted or substituted by one to five substituents selected from the group consisting of halogen, CN, $NO_2$, $C_1$-$C_6$-alkyl, $C_1$-$C_6$-haloalkyl and $C_1$-$C_6$-alkoxy;

$R^2$ H, halogen, CN, $C_1$-$C_6$-alkyl, $C_1$-$C_6$-haloalkyl, $C_2$-$C_6$-alkenyl, $C_3$-$C_6$-alkynyl, $C_3$-$C_6$-cycloalkyl, $C_3$-$C_6$-cycloalkenyl, OH, $C_1$-$C_6$-alkoxy or $C_1$-$C_6$-alkoxy-$C_1$-$C_6$-alkyl;

$R^3$ H, halogen, CN, $C_1$-$C_6$-alkyl, $C_1$-$C_6$-haloalkyl or $C_1$-$C_6$-alkoxy;

$R^4$ H, halogen, CN, $C_1$-$C_6$-alkyl or $C_1$-$C_6$-haloalkyl; or $R^3$ and $R^4$ together with the carbon atom to which they are attached form a moiety selected from the group consisting of carbonyl, $C_2$-$C_6$-alkenyl, $C_3$-$C_6$-cycloalkyl, $C_3$-$C_6$-cycloalkenyl and three- to six-membered heterocyclyl, wherein the $C_3$-$C_6$-cycloalkyl, $C_3$-$C_6$-cycloalkenyl, or three- to six-membered heterocyclyl is unsubstituted or substituted by one to three substituents selected from halogen, CN, $C_1$-$C_6$-alkyl and $C_1$-$C_6$-alkoxy; and $R^5$ H, CN, $C_1$-$C_6$-alkyl, $C_1$-$C_6$-haloalkyl, $C_1$-$C_6$-alkoxy-$C_1$-$C_6$-alkyl, $C_1$-$C_6$-alkoxy, ($C_1$-$C_6$-alkyl)carbonyl, ($C_1$-$C_6$-alkoxy)carbonyl, ($C_1$-$C_6$-alkyl)sulfonyl or phenylsulfonyl, wherein the phenyl is unsubstituted or substituted by one to five substituents selected from the group consisting of halogen, CN, $NO_2$, $C_1$-$C_6$-alkyl, $C_1$-$C_6$-haloalkyl and $C_1$-$C_6$-alkoxy;

including agriculturally acceptable salts or N-oxides thereof.

4. The method of claim 1, wherein the seed produces a plant that comprises in at least some of its cells a polynucleotide encoding a mutated cellulose synthase (CESA) polypeptide having at least 85% sequence identity to SEQ ID NO: 1.

5. The method of claim 1, wherein the seed produces a plant that comprises in at least some of its cells a polynucleotide encoding a mutated cellulose synthase (CESA) polypeptide having at least 90% sequence identity to SEQ ID NO: 1.

6. The method of claim 1, wherein the seed produces a plant that comprises in at least some of its cells a polynucleotide encoding a mutated cellulose synthase (CESA) polypeptide having at least 93% sequence identity to SEQ ID NO: 1.

7. The method of claim 1, wherein the seed produces a plant that comprises in at least some of its cells a polynucleotide encoding a mutated cellulose synthase (CESA) polypeptide having at least 93% sequence identity to SEQ ID NO: 1.

8. The method of claim 1, wherein the seed produces a plant that comprises in at least some of its cells a polynucleotide encoding a mutated cellulose synthase (CESA) polypeptide having at least 94% sequence identity to SEQ ID NO: 1.

9. The method of claim 1, wherein the seed produces a plant that comprises in at least some of its cells a polynucleotide encoding a mutated cellulose synthase (CESA) polypeptide having at least 95% sequence identity to SEQ ID NO: 1.

10. The method of claim 1, wherein the seed produces a plant that comprises in at least some of its cells a polynucleotide encoding a mutated cellulose synthase (CESA) polypeptide having at least 96% sequence identity to SEQ ID NO: 1.

11. The method of claim 1, wherein the seed produces a plant that comprises in at least some of its cells a polynucleotide encoding a mutated cellulose synthase (CESA) polypeptide having at least 97% sequence identity to SEQ ID NO: 1.

12. The method of claim 1, wherein the seed produces a plant that comprises in at least some of its cells a polynucleotide encoding a mutated cellulose synthase (CESA) polypeptide having at least 98% sequence identity to SEQ ID NO: 1.

13. The method of claim 1, wherein the seed produces a plant that comprises in at least some of its cells a polynucleotide encoding a mutated cellulose synthase (CESA) polypeptide having at least 99% sequence identity to SEQ ID NO: 1.

* * * * *